United States Patent 7,745,391 (HUMAN THROMBOSPONDIN POLYPEPTIDE) - sequence listing, part 41

SEQ ID NO: 98818 - DNA, 500 bp, Homo sapiens
  misc_feature (493)..(500): n is a, c, g, or t
taatatatataccctatatactatatggtttatataacatttataatggccctttcagacccatatacttacaaatgacattgtataactacctacatatgtattaatgtgacagaatttagtcctttatggaaagtcaaaccaaattgctagcagttttgagttgaaatgaatgataacaattaaagcttttaagaaattggtaaaggtaccgtaacaaaaactcagcagataaatttaaaagagagggaccatttttgaatgccattttcagagttgacatctaaactagatggtgtgtttaaaaggattttagtggttttgattcatcctttctctgcattcatatcatttagcaaattaatgggacatatgtcatggtttttgtaaaaaagaccattgggttgtcatgattcagtttgtgtttggacatctatggctttcattaaaaacgtgtttattatcatgaataaatattaccatgttttccaannnnnnnn

SEQ ID NO: 98819 - DNA, 677 bp, Homo sapiens
attggtggaataaaatagagaatccagaaatccagtatatgtgcagatttaataaaagataaaggtagtattacagttcaatgggaaatggggagattatttaataagtggtgctggtacaactgtctgcccatctggaagaaaataaaattgggttcctatcttaagataaattccagatggatcaaagccttatagaaatacttaaggttattctccaggtttagttatacaagctagggtaaaggaaatgtgaagataagaaactcagaagctattacaagaggcatatttaattttacaaaaattaagaccttttaatggtaaaggataccataagaaagttaataacagtattggcattaagacagacatattgaccaatggaatagattaggaataggcttggtgcagtggctcatgcttataatcccagcgctttgggagtccaaggttaggaggattgcttgaggctaggagtttgagaccagcctggtcaacatagcaagactttgtctccacaaaagaaagttaaaaattagccaggtggggtggctcacacctgtagtcctagctgcttggaaggctgcggcagtggaattgtttgggtctatgagttggaggttgcagtgagctatgatcatgccactgcactcccctgagtaatgaaagtaatg

SEQ ID NO: 98820 - DNA, 339 bp, Homo sapiens
agaatagagaacccagaaataaacccaaatacttacagccaactgatctttgacaaagcaaacaaaaacataaagtgggggaaaaacacccttttcaacaaagtgtgctggggtaattggctagccacatgtaggaaaatgaaactggatcctcatctctcaccttatacaaaaatcaactcaagatggattaaggacctaaatctaagacctgaaactataaaaattctagaagataacattagaaaaacccttctagacattggcttaggcaaggatttcatgaccaaaaattgcttttgggtaaaagcaattgcataaaaacaaagatacatggct

SEQ ID NO: 98821 - DNA, 660 bp, Homo sapiens
cacaatgctgcagccacctctcgcgtgttctgaaacatttgacctattcactgactgactgactgctctctcagtgagctgtgaggggaggtgactctgtgtggggcccacaccctctgccacctggtcctatagacagactcttctgagtggaggggcagagcggccctgggacctaggagcaagcctggcccgaggcttgtggattgaagaggaaggctggcactgcacttctagaccacatgcatgccctccccccggaggggtcactggtctgttcgcatactcgcagacccctctgggatgccacggaagccaggcgtgtgtgaggaggcagggcagactgcttctccggctttcttctcccactacccccaccccagcgcaaagagtttgttctattgttcagcaaatattcttaggccagaatcttaaatgtttccattctataacaaacactgtgctcatttgtcaacatggagaaacctgatctctactaaaaatacaaaaattagctgggcgtggtggcatgtgcctgtagtcccagctactctggaagctgaggcacgagaatcgcttgaacatggaagcagaggttgcagtgagccaagatcatgccattgcactccagcctgagtgacagagtgagactttgtctca

SEQ ID NO: 98822 - DNA, 791 bp, Homo sapiens
aagaaggtacctgcttcccctttgtcttccaccaggattgtaaattacctgaggcctccccagccatgcggaactcctctatgttgagtactgagatccagcataaaacaggagacttgtttcctgcatgaaacctgcagtattctgaggattaaagatattagatcaacaaccagagaaaagaattatttaagtgtttatgcaaaaaactgtagagagtcctatggaaatacaccagtgaaatagaatatgcacagaatgtgatacactgtacaagataagtgcaccaaaaccatatatttgaactgtgtgactagtatatgacaaagctagagagatttgaattgtgcttctaaaataaaataattactttgcaacttgcgataaaaaaatccatcaatggatcaatcaaaacggcagtgctgtcaaattgtgtaatatagctatactaaaatgtatatatttttatacataatcacaggaaacacaactcatagtcaattatgttatcatattttcccattcaaaaatgtggtatgaaagtattttgcaaattcagtatcaagtagatagtttgtcaggtgtttttacaccacacagaataaatcttatctttgctagacaagaataagtgtgctagttcttttgtattttgacttttaagtttgaggcagaagtgccacggaaatcaacttctgactaggggagataaaataaactcttcaaagagctgagcctgtcaaagtagatgaaaaaaacatctctctcgaatgctcaaataataaatgctg

SEQ ID NO: 98823 - DNA, 173 bp, Homo sapiens
ttcaagaaagtcctcaatcattctaacatttaggtttccaaatgttaactaagcaagcatttttacccctttgatccatgagtcattgtcttgcggtaaaccggtcacctacagctgctgaaatgtcacgttttgccctgtccagacatgtcaacattccaccttctcattct

SEQ ID NO: 98824 - DNA, 231 bp, Homo sapiens
ctccccacgctaacaggaaactactgatgtgttacaaggaaactacaggatgtgtcaaagcctggttagggtggggaggttgaggcgggaggtgcacacaaagtaaatatgctgtatcaattagcttatgctgtgtaacagattaccctaaaactttgatagctttaaacaacaaacattgattaattcgcatgatcctgtggattagcttttctgggccagttcagcttg

SEQ ID NO: 98825 - DNA, 492 bp, Homo sapiens
ggaaatgattttttatttaccattttccaggtactgtggttaggtgctagggatgtaagaaggggtgaacagacaggattcctgacctcctggagtttagagtgaagaagcttaatgattataacagagtcattagagacaattgtgataagtgctacaaggaaaagtacttatcagccaatttatatatttcattccaaatgtttaagtgcctattaaagctaagcaaaatgccaaatactccctaacctcatacagaatacaggcaatgaggaaggtagatattaacccaataatcataaaaaatatgctgagtgctttgaaagaaagacatggttctgagattatgaattaggatttttcttcaaaagcgttctgtgacacatttagttgaaataataggaaatatgtatcatatagtaagggtaagaatcattattcagtttacatatgtgtatgctaggaaataaaagtatactatgggtcatagtt

SEQ ID NO: 98826 - DNA, 605 bp, Homo sapiens
ctgttgtttttagtcttccgcttttgctttagagaaactacacagcttcttctgcacagtcttggggttttcaatcacagtgcccttttcttccccgggcaaaggactggaacataactccagctaggcaaatcagacagtctcctagatacgtgaatgtaaagagagagaaattatacaggaaaataattcaaactgattcttaaccactgccaagtcagcccactgtgatgtctacaacctagattctttattcctgtttttgttaattcaatgaacttccccatctttcccgttttttgcttcagataactagactgattctgttgcttgcaaacaaaaaacctggagtcaaggaaccaagagtatgaaagaggtcaccacaagtcacatagcaacaagcaggaaccataaatcagaggaaagcctggtctattgggagcagagagaaagagagaaaacagaattatggcagaacactagacttggaagcctagtactgttgctactaaggggaatacatgataattcagtccctaagaatgtgttacattctataacacatgccaattatccatgaagccagaaagtgaaaacaatcagtt

SEQ ID NO: 98827 - DNA, 436 bp, Homo sapiens
actactatatttcagaattatctctgaagacttaatagactaacagttgtaaagtattgtaaatacatctttccagtaattgttacatcagtacttaaaggaaacctgttccatctttggacagtgctgttaaaaaattgcttctaagaacaaataggaaacttgtttatggttactcaggatttcataatccaacctaataccgcttctacaaaatagcaataaaggcagctatactctcccattttagttgactagtatatttaaataaaatattataaaccataactgttcaagtttggagagctaacttttcctaaatactaaggggttaccttttaacacacccaagcatcctttcttttcattttaatttttttgcataaaaaacattttaaaatgtatttgatacttcttatctttaaaatattttcag

SEQ ID NO: 98828 - DNA, 311 bp, Homo sapiens
ttcccagcattcactcgtgtagccacagggaccacgcaggaaaataggggtcaggaccccagctgcttccagacctgcttctctcatagcagtcattggttttgatctcagctcattaaaatctttaaaaacaaaaacaaaacaccttcttgaaattgtgaaaatcaacagttaacccaggcctgtttatgaagtagtatgtccagaagtaacacctcacagtgcaaaacaaacgcattcatctgcatgtatagaatgaatcctgttttcttgtcactttcacttttctaactgaagtttccttgtaatga

SEQ ID NO: 98829 - DNA, 893 bp, Homo sapiens
agcggactcatgcctgtaatcccagcattttgggaggccaaggcgggtggatcacctgaggtcaggagttcgagaccagcctggccaacatgatgaaaccagtctctactaaaaatacaaaaattagccaggcacggtgctgtgcacccataatcccagctactctgaaggctgaggcacgagaagcgcttgaacccgggaggtggaggttgcagtgagccaatatcatgccactgcactccagcctgggttgacagagtgagattcagtctcaaaaaaaataataattataaataaataaataaatctcatgagctcagatgtctaaaatcttatctcaatcacctaagtcaagtacttataagaatctgagcatgatccctcctgggtcaaagtttctctccaactgtggacctgtaaaactagaaaacggattatctgctccccagatgcaattgtggaacaggcatgggatatcagttacaggggtttttgattaaaaaaggaatcaatgaaaagaaaaaacaagttaccacatccaaacaattttggaattcagttaggcagtccggatgcagtggctaatccctgtaatcctaacactatgggaggccaaggtggttggaatgcttgagcccagacattggagaccaacctggacaacgtggtgaaaccccacctctgaaaaagaaaaaaaaaatacaaaaacagattagctgggtatggtggtgcatgcctgtagtccaacctactcaggaggctgaggtgggagaatcacttgagaccagggaagtcgaaggtgcagtgagtgatcacatcaccacactccagtctggccttcagggtgagacactgtttccagaaaaaaaaaaaaaaaaaaaaaggagaggaga

SEQ ID NO: 98830 - DNA, 295 bp, Homo sapiens
gagaaacataattttttactaaagtacattcatgattctgacaaattttctacattgtatatcttaatgactaaaaccacactttgaataatttgatgattagatacggaaagtgagacaaaaggagcttcattatataatacatttctaatatgaataaaatacatttggaaacctgaacagaaatattacgactagtaatagcattttcgttatctagagatcaccctaaggagaggctattgagaggtatagggagatcaatttagatgtgagttagagaattttaatttga

SEQ ID NO: 98831 - DNA, 375 bp, Homo sapiens
gctgctatggagtgtcagtctcagaggttcaatttttgattaatagaatttcctgaaagaggaattgaaaaggagggaattatccaagcaaaaataggtataacctgcttggagctaaggaaaatcatgacactaaaatgaaagctctcactgagatagggaggtgatatggtttgtcggtgtccccacaaaaatctcatcttgagttcccacactgttgtgggagggacccagtggaaagtaattgaatcatgggacaagcctttcccatgttctcatgatagtgaataagtctcctaagatctgatggttttatacagaggaattcccctgcacaagctctctctttgcctgctgcaatccatgtaagatgtg

SEQ ID NO: 98832 - DNA, 1312 bp, Homo sapiens
catctgggaaccttcttaggcagccatttccatggtgggggctccattcccgggaggggtacctgaggagattcccacaggttatttacatggtaggggttagcaactgggcctacgttctccagaaccatgggctgtcctgacagcgccagtggtccttggattcatgaggactgaagctgagagtcgtgttccatccacatgagaggggcagggtgaggagcatgggccgtgctgtgtattaaggaaatgcacgtggctcctgcttgtcatcccagcactctgggaacctgaggctggtggattgcttgagcccagacgtttgagaccagcttgggcaatatagcaagaccctgtctcgacaaaaaataacaaaaaattagccaggcatggtagtgcacacctgtattcccagctactcaggaggctgaggtgggaggatggctttagcctgggaggtcgaggctgcagtgagctgcgtttgtgccactgcctccaggctgggtgacagagcaagaccttgtctcaaaaaaagaaatctcatggacaccagaggagcgggaagcagcggtggccccgcagcagcagctatgcatcgggaggtggggcttttctgcttctgctcacctttctgctcacattttcccatagtgaacatggattgcctgtgtgtgaacacttttttaagtaaattaaaccttgtggatattttcagtttgtatcttatctgcccctcacagcagaccattgactgttcgatgcttttagaaatctccttcgtgctgagccctgcgtgctctggacccatgcgctctacgcctcctctgggcccctgctcatggcctgcccaccctggctgtccctgtcccctcttgctgatacggttctgctactctggtcctgggctagtgtctgtctctcgtgtgctaaggcagatggccgagagtggtgggtatcccacagtggggtgccaggcatttttacttctatgctttccaaatccacctgcccttccccacccttagcgtggcccttccagtgccctgtcttagacctggcgccacttcacacgaccagccaggcccagggccccgggcatcctccctggcaagtcctcccatcccctgccattggtcttcgtgctcctggtgagcctccgacccaggctgtcccctgactgctgccgtcctggtttgagcccctcctgctctggccgtcctccacacggagcccacatgaacttgtagatctgagtctggccacatccccactgcaggaatgccctagctggctccccacaccacacctgcag

SEQ ID NO: 98833 - DNA, 506 bp, Homo sapiens
ttttttaaacttggatgttatgttgccccaggctggtcttgacgtcttgattgattggaaagtagaacttaatgatggtgttaagaccaaagatggtcaaaaaaaaaaaaagacaaaaattaattctattactaccctccatgacacttctcaccaaagacaaacatcagaaatctccccttcggactattttgttaaggatgttatgcaatgggtgttattattgtgacaggatattgcacagtatgttatcacgttgagagatgttttaactttgaaaacattttcaacatttccttccatttgggacaggttgtagcctacactgtggtgtccagctgaactttatgaagtcaatacactttcctatatttttgcaggccagtacaccttctagttcagctctgtcattgcgaaccctaagggatttacaacttaaactggggaaagtcctagtggcaaagtcccttgtggggccttcctgtgaatgagaagaataaatgttg

SEQ ID NO: 98834 - DNA, 726 bp, Homo sapiens
ttttttaaacttggatgttatgttgccccaggctggtcttgacaaaaaaaaaaaaaaaaaaaatttaaatcagctgggtgtggtggtatgcaactgtactcctagctatgcaggaagctgaagtgggagaatagcttgatcccgggaattcgaggcttcagtgagctaagattgtgccaccactgctgcctgggtgacagagagactttgtctttaaaaaaaaaaaagatttaaaaaataaaatgttggaggagggcttaaatgtcttgattgattggaaagtagaacttaatgatggtgttaagaccaaagatggtcaaaaaaaaaaaaagacaaaaattaattctattactaccctccatgacacttctcaccaaagacaaacatcagaaatctccccttcggactattttgttaaggatgttatgcaatgggtgttattattgtgacaggatattgcacagtatgttatcacgttgagagatgttttaactttgaaaacattttcaacatttccttccatttgggacaggttgtagcctacactgtggtgtccagctgaactttatgaagtcaatacactttcctatatttttgcaggccagtacaccttctagttcagctctgtcattgcgaaccctaagggatttacaacttaaactggggaaagtcctagtggcaaagtcccttgtggggccttcctgtgaatgagaagaataaatgttg

SEQ ID NO: 98835 - DNA, 445 bp, Homo sapiens
gactttttcttcaaatctcattggtcaaagcaagttaaacagctaaatccagattctagaaattcaactccacttcttgatgggcagggtggcaaagccacagaagtgcatgtggagaggatgggaagaatcattgcactcatctttgcgaacactctatacagtatagacaccagaatgatctggggtcaagaatattgataagtctaactttagggaggaaaataaggcatttgatcattcccttcaccaatttatttacagcacttacacaaggaaaacatagcaaggctgtggttcttgacgtgactagtcttcattcttcctgcattagactaaaaaaaaaatacctcataattggaattgtattttagtctcatattcacagaattgtatgaggtacttcttttcatggatgcagagggtccatatatagatagtgctg

SEQ ID NO: 98836 - DNA, 372 bp, Homo sapiens
gctcccgaaggatacagactatgtccattttgtttgctatccacgatgggacataataggccctcagtaaatatctgttgaataaacagacaaaagaattttgggaagtccattttagggcacctcaaagcctgtcctatgttatctaaaccatgccaagtgctcttgtattccactagacagcagctgacattttatctgatcaccatagccatttatgaagcactcactttttaactgtcagggtctggagaagttagaaccgggcagctgttaacccagattgtaggtagccaaccgagtgactgcaagcagggctgagctgcaacagcaccttattgctggctaccaccagcacactgggccccttcg

SEQ ID NO: 98837 - DNA, 394 bp, Homo sapiens
tgtagagatgtgtcacactatgttgcccaggctggtctcaaattcctggcctcaagcaatcctcccgcctcagcttcccaagatgtggagatggcaggcatgagccactgtgctcagcctccattttctgttcttacaactatgcacagagtgataggaatgtctaacaggggctagatggtggtttttagatattatcataaacttcgatggtagcaaaaaggtcctcaaatagtttctaactggatcattccctctaagatacagactcatttgaactgaaaaccacacccatcaatttcctgcttaactaattcagagattctctataccaccagtggaagaaatctaaacctaatcatggcagaagggctctccttgatctagttcttgc

SEQ ID NO: 98838 - DNA, 672 bp, Homo sapiens
aaaagcaaacctaatgggaatggttagagattggatagattattggggtgtttaaaattactggtaaaattcagaacagaccatactgtttgtacagggcccagtgggagaagtgggtaggtcctgagcagggtgatcaggaagggaagagacctgatttgatggagagaattctgggagcagagagattggcatgaaatctgtctcaaaggcagcataagtcagaatatatttgttctttaaccaggaaaaatatctgaccagggtccatgttacagaacaaaacatggcaagaggcaggcatgaatgaggttctgaggaaacagtggtggagagactggaaacctgtgattaaaacaaacaaacaaacaaacaaacacctcaactagaagatagatacaaatagaagggaaaaaagagaaagggaagaaattcacagttacataatactttacagtttagaaaatgctatatatatatattgcatttgattctgtggaaatctgcaaaaagccttttatgtaatttggataaaactttaggagtattgtgtagctctgcagaaaatacagtagaggggagagatgctggagtctggaagacaggtggttcagttgtcaaatgactcagccttggacccagtttgtggccatggcaatgaatatgaagcca

SEQ ID NO: 98839 - DNA, 238 bp, Homo sapiens
caccatgcaagaagtgcctttcacctcctgccgtgattctgaggcctccccagccatgtggaactaactaaacagaaacactgtagaagcaagaggttgaaaatatcatccattttgatgccaacaattgacaatcctagatagccaaagacagccttactaagcaatgtggctgcttttggagtcaaaggaagactcactttgctcaactgttggataaaaagataaagagaagaaa

SEQ ID NO: 98840 - DNA, 368 bp, Homo sapiens
gacgtaatcacaaaaaaagaaagctttaccatgtggattatcaaccacatgtttcttgatcagggccttggtcttggtgatcttatggaagagatcattaagtgtttttcttttagctttttcttcttaaataagcattattgagataaagcaagatataattttaggctgaacacagtggctcactcctgtaatccccacattttgggaagccaaggtgggaggatcctttgagcccaggagtttgagacaaggctggagaacaaaacaacaagactcatctctacaaaaagtaaaaaaaaaaattgccaggcatggtggcatgcacctgtagtcccagttactcgggaagctgaggcaagaggatc

SEQ ID NO: 98841 - DNA, 370 bp, Homo sapiens
gcacctgacatacacctcgtcacttagtcctcacagcagcccctgtggctatcaggacacagagaagttgctacaaaacacacacacagaggccgggcacagtggcttatgcctataattccagaactttgggatgccaaggcaggtggatcacctgaggtcggcagtttgagaccagcctgaccaacatggagaaaccccatctctactaaaaatacaaaattagccgggcttggtggcacatgcctgtaatcccagctactcaggaggctgaggcaggagaatcgcttgaacccaggaggagaggttgcggtgagctgaggtcacgccattgcactgcagcctgggtgacagagcgaaactccatctc

SEQ ID NO: 98842 - DNA, 494 bp, Homo sapiens
gccagaagcccaattgtcattctctctctctctctccctctccctctcttcctccctccctccctccctctccaagatatccagtaactgattgatcagctggcggtgggctctgctggctgccagggtgggccaccagcaaaaagggaaaattggttgtgagtgagaagaagagataagaaagtccacagggctgataagaaagaccatgggcttccaggtgcggtggttcacgcctgtaatcccagcactttgggaagccaggatggccggatcacgaggtcaggagatcgagaccatcctggctcacacggtgaaagcccatctctactaaaaatacaaaaattagctgggtgtggtggcgggtcctgtggccccggctaattgggaggctgaggtgggagcatggcgttaaccccgggaggtgcagcttgcagtgagctgagattgcaccactgcactccagcctgggcgacagagcgagactccgtctc

SEQ ID NO: 98843 - DNA, 440 bp, Homo sapiens
gagccccagggtcccggggagactaaagctggggtctatttctattcccccaaccaagacgggagcttcacatccccacacactgagaggccagaatgggtcagaccagagtgagtgtgctctggctaagactggccgacagctctgttcccctggggtggggactggacgtggccctttggtttaactgcattttactctttccagcctgtctggccattattcttgcaggagcacgcaggactaaagtccccttcctcagcaccacgcatgtcccatctcaccctgtgtcttccaacttcacttgccataaatcagttgtcaggacccccgaccctaaaacagtcacctaatgataaatcatgtttaattctaatggaaccctcccgccaagactactcatcagagaggaagctaattcgcagggatatgaagagctt

SEQ ID NO: 98844 - DNA, 872 bp, Homo sapiens
aagctagttagtggtggaagaactgaggtcagtctcccactttgtagcacagagctaattcataagagccctctgaaagtgagttggggtcatcaggaaactggttgcccaggagagccgtgatgggagaagataccagcctgaatttaaagcaattccatatttggttatgatgtcattttccctgtctctgtctctctcttttgacctggaggcatgaaagattcaaggcagaaactgaaatttaaattgagaaggcgaagaaaggcaacatctcacctccttaataagttataagtagatagtgaggcctgtgctagagtaatgaatggccaagcagaatctgccaacaagggttttcagtacaaagccaccctgaaaccagactttccgtttgcccggaactggcaattttgatgccttgggcaagttgcagtacacgggccctcggtcaactttgtgctccggatttggcacacagaggggtgttactaacaatgtacaccatctgctagcttcccgttttaactaattattcttgttaactaggtgctaagctcagttgtttctagacagttgaaggaatgctgggctgtcaatgtgtaaatctaacaaaatttacagtcacataatcttttaaaaccagtattaatactttcttgcaccctttaaattttggtatcctggcacaaagccaagtcacctgccttggctctgtgtaagtctcaccaatggacttgttactagggaggtgcagagtaagttaataagtgatgtgcgccgtgctcagtacacatgtgtttgggctgggaggagacaatggattgctctagaatcacctggagacattttctactctgctgtatacccca

SEQ ID NO: 98845 - DNA, 309 bp, Homo sapiens
tctcacattactacaaagaactacctgagactgggtagtttataaagaaaagaggtttaactgactcagtttgacaggctgaacaggaagcatggctggggaggcctcaggaaacttacaatcatgcaggaaggtgaaggggaagcaggcaaaatcttcacatggagagaggagagagagaaggggggagtgctacccagctttaaataaccagatcttgtgggaactcactcactatcatgagaactgcaagagggaaatttgcccccatgatccagtcacctccaccaggtccctcccccaacactg

SEQ ID NO: 98846 - DNA, 570 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98847 - DNA, 1072 bp, Homo sapiens
ccctgactcttctttgcccccagaatatgctttagggagtcacagacaacagaacactgcctcagggcgctgtcatcactctattcaaatggaaaaattcttaaactagagagagtgtgagcatcaaccacccaatgtgcagtttccacctccgccccagcacattcccaggagagcaggggagcaggagatgagctgtcctgcagtaagtcctggccaacgccctttgataggttccatctcacctaatcctcctgtctccttcgagggaggctggatgagggattcaatagacaggttgacctgtccaagtcatcagctaataaatgttaaatccagggctcaaacccatcaagcagcaactattgcattgctgctgaaactgaggggctccttttcaccctgatgacatggtatgtcattccagcagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98848 - DNA, 878 bp, Homo sapiens
  misc_feature (608)..(608): n is a, c, g, or t
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgttttaaaaaaaaaaaaacgaaaaaaaaaaaaaaaaaaaaaaaaaaaaaaancccccggggtttttttttttttttttaaaaaataaattttttgggttgccaaatttttaaaaaaaatttttgaaaacgggtaaaaaaaaaaaaaaaaaaaagttggcaaaaccgggaaaataaacctatatggcaaaatttcccttttgccccaaaaaaagtttttttttttttttttgcaaaaagttcgccttaaaccggttaaagggttttttgtttggcccccaaacccgtttttaaatgaaaagcccggtcttttggcattgaaaa

SEQ ID NO: 98849 - DNA, 691 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgttttaaaaaaaaatgccccggaaccccctttcttgcggagagagaaggtgttttttaactcgggggggggcccgggccccaattggcccattgtgagtcggattcctaccgtgcccgggtttgcgtctgcctgg

SEQ ID NO: 98850 - DNA, 746 bp, Homo sapiens
  misc_feature (564)..(564): n is a, c, g, or t
  misc_feature (609)..(609): n is a, c, g, or t
  misc_feature (623)..(623): n is a, c, g, or t
  misc_feature (731)..(731): n is a, c, g, or t
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattactcgtgccgaattcggcacgagcctgngtctgctgctgcctcaaggtgtcctgaccttgaggctgatgaggngacccctgcctgtntcccccatactgagttctagggaggtgctcaccccagactcttaggaagggtctagagaaatgagaggagcccaaagccaggggccagcttcgagaaagggtaacctncacgcttctctctcc

SEQ ID NO: 98851 - DNA, 602 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgttttaaaaaaaaaatgatagttggcctttccctactgatgaaaaa

SEQ ID NO: 98852 - DNA, 543 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcgtcacccaatgtcatggtattggtgattatgtcttcaagagaatcagcaagagaatt

SEQ ID NO: 98853 - DNA, 684 bp, Homo sapiens
tctaaatcaagtggatccccggctgacagaaattcggcacagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98854 - DNA, 454 bp, Homo sapiens
  misc_feature (7)..(7): n is a, c, g, or t
  misc_feature (64)..(64): n is a, c, g, or t
  misc_feature (90)..(90): n is a, c, g, or t
  misc_feature (119)..(119): n is a, c, g, or t
  misc_feature (159)..(159): n is a, c, g, or t
  misc_feature (166)..(166): n is a, c, g, or t
gatcgantgactcgaggactccgagcccaagtagatgacctgactgaagctgtggctgcaaagnattcccagctggctgtactgaaagtnagactccaggaagctgaccagctactgantactcgcacagaagcattagaagccttacagagtgaaaantcacgantaatgcatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98855 - DNA, 1091 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaaccctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccagttatgcagtcagccttggtgcctggctgcca

SEQ ID NO: 98856 - DNA, 195 bp, Homo sapiens
  misc_feature (74)..(74): n is a, c, g, or t
ttcggcacagctaaaagattttttgaagcagagatgtttataattaaatgataaaatgttgccaaattggactntgggaaaaaagctaaaatagcattttacaatgatataaagagaatttaaacaagtctgcatttcatattattttagtgtgtaaaattaatgtaataaagtgaactttgttttaaaaaaaaa

SEQ ID NO: 98857 - DNA, 832 bp, Homo sapiens
  misc_feature (562)..(562): n is a, c, g, or t
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaccatgacattgggtgacattgtcttcaagagaatcagcaagagaatttaaacaagtctgcatttcatattattttagtgtgtaaaattaatgtaataaagtgaactttgttttaaaaaaaaaaaaacgaaaaaaaaaaaaaaaaaaaaaaaaaaaaaaancccccggggtttttttttttttttttaaaaaataaattttttgggttgccaaatttttaaaaaaaatttttgaaaacgggtaaaaaaaaaaaaaaaaaaaagttggcaaaaccgggaaaataaacctatatggcaaaatttcccttttgccccaaaaaaagtttttttttttttttttgcaaaaagttcgccttaaaccggttaaagggttttttgtttggcccccaaacccgtttttaaatgaaaagcccggtcttttggcattgaaaa

SEQ ID NO: 98858 - DNA, 727 bp, Homo sapiens
  misc_feature (658)..(658): n is a, c, g, or t
  misc_feature (668)..(668): n is a, c, g, or t
  misc_feature (721)..(721): n is a, c, g, or t
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgttttaaaaaaaaagttatcaataagctcctagtccagacgccatgggtcatttcacagaggaggacaaggctactatcacaagcctgtggggcaaggtgantgtgggaagntgctgggagggagaaaaccctggggaaggcttcctgggtttgttcttaccccntgggac

SEQ ID NO: 98859 - DNA, 1442 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaaccctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccacagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98860 - DNA, 3098 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtgagtttctgtggccccttgggagacacagtgcccttctctgtccctccatgtcatgtcgtttctctcacctacctaccacggtcatgaaactcccacctctgcccatatctaaacctcagacggtttccaccaggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgtggaagctgtgtggtgatagggagagacttcttgaaggaggtgctagcaataccagaataccagggccccagacaggtgctcagaccctgccttcaggggtggtcacaaagtctctggcttcagccaccccatctgtaaaataagaacagtcaacctccctagactgaaggcagtgcagggcagcatcacttctgctgggcacaactcatggtgtgcaatgacagctggggtgtgggctgtgtgagtggttggcagatggtggcagggggatcctggcaatgggggtgcccgtctcctcctccctctgaaacactccatgctctagcagccctcttctctcctccccgtggacagctctgttcattgggctgggcgtgtttgctttttatctcttctggtcactctttatttctgcctctccaattagaacattacaggtcaggatgattttaggaggataatattcttgatgtgctcatggtcaagggatttaactatgggccttttccaaattttctttttggaggcaacatagcaagacctcatctcaattaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaccagagaactagaggcttgggatcataggaaccagagcattttggttgttatgagctgagacctgtgcaaaggaagcaacttcattagcaaggctcttgccccccaccaccccttcctcacaggtcacctctctgttccctgcagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaaccctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccacagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98861 - DNA, 3152 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtgagtttctgtggccccttgggagacacagtgcccttctctgtccctccatgtcatgtcgtttctctcacctacctaccacggtcatgaaactcccacctctgcccatatctaaacctcagacggtttccaccaggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgtggaagctgtgtggtgatagggagagacttcttgaaggaggtgctagcaataccagaataccagggccccagacaggtgctcagaccctgccttcaggggtggtcacaaagtctctggcttcagccaccccatctgtaaaataagaacagtcaacctccctagactgaaggcagtgcagggcagcatcacttctgctgggcacaactcatggtgtgcaatgacagctggggtgtgggctgtgtgagtggttggcagatggtggcagggggatcctggcaatgggggtgcccgtctcctcctccctctgaaacactccatgctctagcagccctcttctctcctccccgtggacagctctgttcattgggctgggcgtgtttgctttttatctcttctggtcactctttatttctgcctctccaattagaacattacaggtcaggatgattttaggaggataatattcttgatgtgctcatggtcaagggatttaactatgggccttttccaaattttctttttggaggcaacatagcaagacctcatctcaattaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaaagaagtcgtgacattttatttagttcttaaatgcacctcacttctatttggagccagagaactagaggcttgggatcataggaaccagagcattttggttgttatgagctgagacctgtgcaaaggaagcaacttcattagcaaggctcttgccccccaccaccccttcctcacaggtcacctctctgttccctgcagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaaccctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccacagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98862 - DNA, 2701 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgtggagtttgtgaaaaacccttaactgagcccaaagtcaactggccttcactgaacctagagctgtgtggtgatagggagagacttcttgaaggaggtgctagcaataccagaataccagggccccagacaggtgctcagaccctgccttcaggggtggtcacaaagtctctggcttcagccaccccatctgttctgctgggcacaactcatggtgtgcaatgacagctggggtgtgggctgtgtgagtggttggcagatggtggcagggggatcctggcaatgggggtgcccgtctcctcctccctctgaaacactccatgctctagcagccctcttctctcctccccgtggacagctctgttcattgggctgggcgtgtttgctttttatctcttctggtcactctttatttctgcctctccaattagaacattacaggtcaggatgattttaggaggataatattcttgatgtgctcatggtcaagggatttaactatgggccttttccaaattttctttttggaggcaacatagcaagacctcatctcaattaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaccagagaactagaggcttgggatcataggaaccagagcattttggttgttatgagctgagacctgtgcaaaggaagcaacttcattagcaaggctcttgccccccaccaccccttcctcacaggtcacctctctgttccctgcagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaaccctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccacagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98863 - DNA, 3088 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtgagtttctgtggccccttgggagacacagtgcccttctctgtccctccatgtcatgtcgtttctctcacctacctaccacggtcatgaaactcccacctctgcccatatctaaacctcagacggtttccaccaggtctgccggaagagctcatccagaaggggaaggatatcaagggggtgtcggaaatcgtgcagaatgggaagcacttcaagttcaccatcaccgctgggtccaaagtgaggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgtggagtttgtgaaaaacccttaactgagcccaaagtcaactggccttcactgaacctagagctgtgtggtgatagggagagacttcttgaaggaggtgctagcaataccagaataccagggccccagacaggtgctcagaccctgccttcaggggtggtcacaaagtctctggcttcagccaccccatctgtaaaataagaacagtcaacctccctagactgaaggcagtgcagggcagcatcacttctgctgggcacaactcatggtgtgcaatgacagctggggtgtgggctgtgtgagtggttggcagatggtggcagggggatcctggcaatgggggtgcccgtctcctcctccctctgaaacactccatgctctagcagccctcttctctcctccccgtggacagctctgttcattgggctgggcgtgtttgctttttatctcttctggtcactctttatttctgcctctccaattagaacattacaggtcaggatgattttaggaggataatattcttgatgtgctcatggtcaagggatttaactatgggccttttccaaattttctttttggaggcaacatagcaagacctcatctcaattaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaccagagaactagaggcttgggatcataggaaccagagcattttggttgttatgagctgagacctgtgcaaaggaagcaacttcattagcaaggctcttgccccccaccaccccttcctcacaggtcacctctctgttccctgcagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaaccctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccacagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98864 - DNA, 526 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaattaccatgacattgggtgacttgtcttcagagaatcagcgatgagatgttgaagggcgatgagatgttggaagagccatg

SEQ ID NO: 98865 - DNA, 1645 bp, Homo sapiens
cagtccgtcgaagcttccgaatggttgggactaccgtgctgacgcatgtcaccatgcagctaattttaaaaaattttttgtagagatgggggtcttgccatgtgcctaggagttcaagaccagcctgggcaacatagcaagacctcatctcaattaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaaagaagtcgtgacattttatttagttcttaaatgcacctcacttctatttggagccagagaactagaggcttgggatcataggaaccagagcattttggttgttatgagctgagacctgtgcaaaggaagcaacttcattagcaaggctcttgccccccaccaccccttcctcacaggtcacctctctgttccctgcagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaaccctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccacagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98866 - DNA, 2332 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtgagtttctgtggccccttgggagacacagtgcccttctctgtccctccatgtcatgtcgtttctctcacctacctaccacggtcatgaaactcccacctctgcccatatctaaacctcagacggtttccaccaggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgtggaagctgtgtggtgatagggagagacttcttgaaggaggtgctagcaataccagaataccagggccccagacaggtgctcagaccctgccttcaggggtggtcacaaagtctctggcttcagccaccccatctgtaaaataagaacagtcaacctccctagactgaaggcagtgcagggcagcatcacttctgctgggcacaactcatggtgtgcaatgacagctggggtgtgggctgtgtgagtggttggcagatggtggcagggggatcctggcaatgggggtgcccgtctcctcctccctctgaaacactccatgctctagcagccctcttctctcctccccgtggacagctctgttcattgggctgggcgtgtttgctttttatctcttctggtcactctttatttctgcctctccaattagaacattacaggtcaggatgattttaggaggataatattcttgatgtgctcatggtcaagggatttaactatgggccttttccaaattttctttttggaggcaacatagcaagacctcatctcaattaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaccagagaactagaggcttgggatcataggaaccagagcattttggttgttatgagctgagacctgtgcaaaggaagcaacttcattagcaaggctcttgccccccaccaccccttcctcacaggtcacctctctgttccctgcagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccagcactttgggaggctgaagtgaaaggactgtttgagcctaggagttcaagaccagcc

SEQ ID NO: 98867 - DNA, 2233 bp, Homo sapiens
  misc_feature (2233)..(2233): n is a, c, g, or t
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtgagtttctgtggccccttgggagacacagtgcccttctctgtccctccatgtcatgtcgtttctctcacctacctaccacggtcatgaaactcccacctctgcccatatctaaacctcagacggtttccaccaggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgtggaagctgtgtggtgatagggagagacttcttgaaggaggtgctagcaataccagaataccagggccccagacaggtgctcagaccctgccttcaggggtggtcacaaagtctctggcttcagccaccccatctgtaaaataagaacagtcaacctccctagactgaaggcagtgcagggcagcatcacttctgctgggcacaactcatggtgtgcaatgacagctggggtgtgggctgtgtgagtggttggcagatggtggcagggggatcctggcaatgggggtgcccgtctcctcctccctctgaaacactccatgctctagcagccctcttctctcctccccgtggacagctctgttcattgggctgggcgtgtttgctttttatctcttctggtcactctttatttctgcctctccaattagaacattacaggtcaggatgattttaggaggataatattcttgatgtgctcatggtcaagggatttaactatgggccttttccaaattttctttttggaggcaacatagcaagacctcatctcaattaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaaagaagtcgtgacattttatttagttcttaaatgcacctcacttctatttggagccagagaactagaggcttgggatcataggaaccagagcattttggttgttatgagctgagacctgtgcaaaggaagcaacttcattagcaaggctcttgccccccaccaccccttcctcacaggtcacctctctgttccctgcagacagtggttcagttggaaggtgacaataaactggtgacaactttcaaaaacatcaagtctgtgaccgaactcaacggcgacataatcaccaattgtaagttggtggtgctctgagcgtgtggctcccagtgcttgaggggcactttaaccccaaactttttttctgtgn

SEQ ID NO: 98868 - DNA, 2001 bp, Homo sapiens
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtgagtttctgtggccccttgggagacacagtgcccttctctgtccctccatgtcatgtcgtttctctcacctacctaccacggtcatgaaactcccacctctgcccatatctaaacctcagacggtttccaccaggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgtggaagctgtgtggtgatagggagagacttcttgaaggaggtgctagcaataccagaataccagggccccagacaggtgctcagaccctgccttcaggggtggtcacaaagtctctggcttcagccaccccatctgtaaaataagaacagtcaacctccctagactgaaggcagtgcagggcagcatcacttctgctgggcacaactcatggtgtgcaatgacagctggggtgtgggctgtgtgagtggttggcagatggtggcagggggatcctggcaatgggggtgcccgtctcctcctccctctgaaacactccatgctctagcagccctcttctctcctccccgtggacagctctgttcattgggctgggcgtgtttgctttttatctcttctggtcactctttatttctgcctctccaattagaacattacaggtcaggatgattttaggaggataatattcttgatgtgctcatggtcaagggatttaactatgggccttttccaaattttctttttggaggcaacatagcaagacctcatctcaattaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaccagagaactagaggcttgggatcataggaaccagagcattttggttgttatgagctgagacctgtgcaaaggaagcaacttcattagcaaggctcttgccccccaccacggacagcacagaggaggtggacagca

SEQ ID NO: 98869 - DNA, 1374 bp, Homo sapiens
  misc_feature (1251)..(1251): n is a, c, g, or t
  misc_feature (1270)..(1270): n is a, c, g, or t
  misc_feature (1322)..(1322): n is a, c, g, or t
  misc_feature (1330)..(1330): n is a, c, g, or t
ctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtgagtttctgtggccccttgggagacacagtgcccttctctgtccctccatgtcatgtcgtttctctcacctacctaccacggtcatgaaactcccacctctgcccatatctaaacctcagacggtttccaccaggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgtggaagctgtgtggtgatagggagagacttcttgaaggaggtgctagcaataccagaataccagggccccagacaggtgctcagaccctgccttcaggggtggtcacaaagtctctggcttcagccaccccatctgtaaatangacagtcctcctagctgangcgtcaggcagatactctgtggacactatgtgtcatgacagtggttggctgnttgtgcanatgtgcggggatcttgcatgggtgccgttctctccttgacatct

SEQ ID NO: 98870 - DNA, 1019 bp, Homo sapiens
ccctgactcttctttgcccccagaatatgctttagggagtcacagacaacagaacactgcctcagggcgctgtcatcactctattcaaatggaaaactccgccccagcacattcccaggagagcaggggagcaggagatgagctgtcctgcagtaagtcctggccaacgccctttgataggttccatctcacctaatcctcctgtctccttcgagggaggctggatgagggattcaatagacaggttgacctgtccaagtcatcagctaataaatgttaaatccagggctcaaacccatcaagcagcaactattgcattgctgctgaaactgaggggctccttttcaccctgatgacatggtatgtcattccagcagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaaccatgacattgggtgacattgtcttcaagagaatcagcaagagaatttaaacaagtctgcatttcatattattttagtgtgtaaaattaatgtaataaagtgaactttgttttaaaaaaaaa

SEQ ID NO: 98871 - DNA, 472 bp, Homo sapiens
ggtctctgcctccttccgcatgtggtcccagcaggctaagaacagtcgccgagggaaaatatttcttgggcgcatatttgaggagcttcctgggagtgagtcagaaggcgaatgccgtttaaaggctgcaagagaagccatgctggtgaagcggacccttccacctcgggatgtttcaggactaggctgagggcaaaggaaactgccaccacctccctacacctccccaccctccaggacccccaccccatcactgggcacacaaccccggtccagtgctcatcccaccgtgaggacgtggaggccggaaggagccgtcacacgggcctgccctgcagatgtggttgaaggagtctccacgggaatcatgactcccagagcgaggctggggcttggggcgccggggaggcagcttggatttaggagccccagtgccaagtctttgccgtgaactgttctggcccctgtgacc

SEQ ID NO: 98872 - DNA, 476 bp, Homo sapiens
ggtgtatcgcgtggttgccgctgttagcggcagtcaggcgaggagcggacgctgcaggtcggctttgtcttgggcgcatatttgaggagcttcctgggagtgagtcagaaggcgaatgccgtttaaaggctgcaagagaagccatgctggtgaagcggacccttccacctcgggatgtttcaggactaggctgagggcaaaggaaactgccaccacctccctacacctccccaccctccaggacccccaccccatcactgggcacacaaccccggtccagtgctcatcccaccgtgaggacgtggaggccggaaggagccgtcacacgggcctgccctgcagatgtggttgaaggagtctccacgggaatcatgactcccagagcgaggctggggcttggggcgccggggaggcagcttggatttaggagccccagtgccaagtctttgccgtgaactgttctggcccctgtgacc

SEQ ID NO: 98873 - DNA, 260 bp, Homo sapiens
acttttaatgttatcttctgttggaaatacccttcctgtgaagttcccctgcttgccagtgagatttggagaactgactgtggcttatgtgtgctttaatcttcagtgccttgcatagtgatgttttttgcccccacgtgaatcattcaagagttaaacaagagaaatggttcctgtcagtgcaggtgatgaaagagatcattacaacataactgaaggtcaagacaaggataaataccagcaaaatcaatagagaacga

SEQ ID NO: 98874 - DNA, 313 bp, Homo sapiens
agcgggtggcgcgtgccgagccgcgagccccaggcaggccaggtaacggcctctgcccccgcccctccctccccgctcggacttcccttacccgcacactggctccaggcagcgcccgggcggcggaggcggctgcggagacggcggggtgcgggctgagggagccgggcctggacgccccccccatcacccccgtaccccaggagctgtgcctagtccaggagaggctggggggcgccccatggaggtgagacgcggagacacctgacaccgcgaccctcacaccctcaggacctgagggaggaaggacttg

SEQ ID NO: 98875 - DNA, 447 bp, Homo sapiens
tcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagc

SEQ ID NO: 98876 - DNA, 215 bp, Homo sapiens
aatacatttatcctttcccatcatgcccaattctgggaattcatcctaagatatatctgctcatcaaattaagtatgtataagattattcaaatgtagcattgcttgaagtagcagaatactacaaacaactcaaatattcgtcaatacagaatgggtgaaatgaacatgcaatacatgggggaagaccttttttccatatatagtgatatggaa

SEQ ID NO: 98877 - DNA, 163 bp, Homo sapiens
aagatgtccaacagtgggggagatgggggaaagggtacacagtggagggtgcatgggacctccctgtacatcaccctgcaacttcctgtgagtctataattatttcaaaataaaaaggtgttctaatgagggtgtagagaaatggatgttcttgctggtagta

SEQ ID NO: 98878 - DNA, 227 bp, Homo sapiens
gtgaaaatgggaagccaagaaaatagatcttctgttttctggtgaaaatatgtgcatgtgaagcattttgtttgtaacagataactttttgctttagttatgattttattagtttttatctgaactttttattgatagtgatagctggaaccatcttcagtgaaaattgattcgttgaaataaactgaaggcattccgaaggaggagggaaaaaaatacgtaaaaag

SEQ ID NO: 98879 - DNA, 551 bp, Homo sapiens
caaatctcagctattggactgagactcaggggtctatctgacttgaattgaaaatgcaaattactgaagagggagggagggaggagtgctgaagattgaatggatttatcagatttccttctcctatggcccagatgcaggcctagtccaggcgattcccctggctcagaatctgccaggctcaagcattcattgacagcctactatgtaccaatcctgggctgagtcccaacccggggatgacttagaggaggccaggatgtggcctcatgttctggttgctctcacatttaaacaggctaaacccactttgcattgtatgttaggggtggtgcttgtgggacaaagggggctgtcagaacattctggctgccacatgaagttgactttgccaggacagactgggttgtgggggaaggcagctactgtaataatttggccaagaagtgggctgagcaggagcagggctgagggagggagagagggaatgagtaagaaaggcccagggtactgatttgactgggacttcagggacaggtgtggggcgagag

SEQ ID NO: 98880 - DNA, 555 bp, Homo sapiens
acaaagaaacaaaaaccggcacatgcggttactgtgggctccagttcagacagcaccaccactagagcgtgtggcacgccgggggtcccgcagcatcctgtgagcatttccgcggggaagctgagctggttctgtgcgaagggtattcctggtgctgaataaagggtgttgctgtcaaggctgacaatttatatctgtgtgaggctggattttctttgcctactccaaccaaagcgacacatcacagcagactggatgcagaagcgtgcgtgggaatgcagctgttttccatggaaccagacgctacagagactgcaacgtgtaaaacactgccattcttttcattcctttgaataatttttttaaaatttgctatttaacacgtaatagttttttattttaaaatgaattaatacttttttttttgagatgcagtcttgctctgtcgcctaggctggagtgcagtggtgcaatctcagctcactgcaacctccaccttccagtttcaagtgattctcctgcctcagcctcctgagcagctgggattacaggcac

SEQ ID NO: 98881 - DNA, 340 bp, Homo sapiens
cctaaatagaatgctaaaagtcatgtgatgctcaatcagcaaaccagggattggcttcatcctgggaaaaagctatctgggtgcaacaagacacaagctctcaaggagtttgcaaactggaccactgttctggagttatgcaattaaacactgcacaattgcaattaaacatggacagaaaatcctcctccccgttgttcttagaacaagaataacaatgaagttaaaagccacctggaagggcccctcctcacccttgttctctcagtttcactcttagtcctcctgaggcccacagcaccactgctgtcagccagcctcttggcaggttgataggtga

SEQ ID NO: 98882 - DNA, 373 bp, Homo sapiens
actcttttatattatgacagacaagccaatcctgcctgagcttttctgccaacacattagcattcatttctttcaaattgaagaactccttttggcattttttataaggcagctctggtgttgatgaattccctcagcttctatttgtctgggaaagtctttatctgtctttcatgtttgaaggatattgttaggtacagtattcttggatagcagttttctttcttcaaaactttgaatatagcatcccagtctatcctgaccttcaagatttctgctgataaatctactgaaagccatataggagctccattgaatatgatatgattcttttcttttgatgctttgaatatttcttctttgtccttgattt

SEQ ID NO: 98883 - DNA, 438 bp, Homo sapiens
aactaatatataaactcacttttagaaaggctgttaactatcaaagtgtctcataaatggacacatatttatgtgttatatgtaagttactttttcagtgttcatgatcaggattgattttctataatcagtattttcaacatttattaaaagcttctatttatgtatacacatttaactccaaagtattttaatacactttggtagtcttatgacttagtctatcttatattatgttcactgctttggcattcagtcaattttaaaagcatgtttctatttcatgtttctttttggcatattttacaaaaagtaatatgtagaattataaataaaggatgaggcctcggtctgtagagaatttaccttttcttttgttcttgcttggaaacacattattttacatgggtttatgttgctttgatttcagtagtttta

SEQ ID NO: 98884 - DNA, 608 bp, Homo sapiens
cgcacattacaaatggaaaggcggcgcgtggagggaactcaaggcctgattggttcgtcctaagcaggacgcgacagggttggcagggcaaccggccttcggttagtgccttcagtgggtgccttcagttggtggcattcggttgcctttcctggggagaggtggcaggtgctctactctgcagtcgtgggggcaagcgaaggcccaagctgccggagaagagcagagttgccccatggggaccacgatgacttgtcacatgtgcaccaaagccagccccaggcagggcctgcgcagggcttctgcggagccgttctgcggctctgacatctatgagtgggcagccagcaaaggcgcaggccccagcacagaggagcagaggcgcccggaacacgctgtcccccaatgccagccccaagctgggccaacactgggtgcagtgttgggagcagtcctgcagctctgagatccactagttggaggtgggagaagtgccagattccactgatttgaaacctgcccagcctgattccggagccgtgacttacagcacattggctaccagaagacgcccaaaggtagggaggagacagttcgctttcctatcc

SEQ ID NO: 98885 - DNA, 197 bp, Homo sapiens
tgctgggattacaggcgtgagccaccgcgcccagtctagaaaatcttttaattctccacttaatacatttatgaacttatgtcatcatctcaatagattaaaaagaacctcaataatactcatcattttaaaaaagaagaaaaactcctaacatatcgagaataggggagaatttctttaacctaataaagagtaac

SEQ ID NO: 98886 - DNA, 248 bp, Homo sapiens
ttcatggtctctacttactcatgtcccccattaaactataaagcctctactgcctaatgtcggcctctaatctctactgaaactgctcttgccaaatgaaaatgacagggacaatttctactctttaaatgacctctaggtggcactggacatagttaataattttctcaatcacacttcctccctggatcctgtctctctttggttttccagtgcgctctcttttgctgttttttcttaaggtctgc

SEQ ID NO: 98887 - DNA, 350 bp, Homo sapiens
ttgacaagtaagtgtatatatttaaggtgtacaatgtgatgctttgatacatacagtgtgaaatgattaccacagttaggtttaataattaacatatccatcatctcacataggtatgatttcttatgtgtgtggcgagaatcctgaaaatcaactctgagcacatttcaagtgtacaatacagtatttatgatagtcaccatgctgttaatcagattgcctaccttggttaaagtgcagactcaggtgaaggtctggatggaggatcatactttaattgatttagactctaaaataaatgtatatagttatttttgctaacctaagaacctactcataaatggctagtg

SEQ ID NO: 98888 - DNA, 199 bp, Homo sapiens
tgggagggaaaaggggctaagaacagagtggagcggcttctgtgatggaggcttggtgttcacgtcactttggaatagtgtcctggtattggggaaaacatcttgcagtccgctttgatagaatttcagccagaattccttcctgttcagtttatcctcagcgcgtcttcccttctgactcctcccccagcagagcctc

SEQ ID NO: 98889 - DNA, 894 bp, Homo sapiens
tcattgaaaagcagtgaaacactttttttttaattgaaggtgagaaccaaaaggaagtttaaagaatattccaagtgagcagagggggtggcgggatcacccaaaaatgctactttgtggttatggtcattataagcataaaatatatctaaaatacttgaaagttatcactttaataaaacaacaaagagatagaaaaagccttgctgaagcaagggaggctgatgtgcacaggacgaacagaagtgaagtgaggaagaacaagggaaacttcgtggcccaggcccgcgtgcatgcctagctgggtttaccacccccgcgagggccccatgccacgcgtggacaccgtcagcccagtggccagagcctggctgggtttaccacccctgcaagggcctcatgccacacatggacaccgtcgggccagcggccagagcctggctgggtttaccacccccatgagggccttgtgccacacatggacactgttggcccagaggccagagctccccaaagccagggctgctgcctggagaacagttacccttggggtgggagcggtacctcccacgagctgcaatgggactgtgtgtgccgccggcacctggcattgcgcattctgcgtgtgtcccaggaggaccctgtgcggagactgttccacactttccacatttgcttctcctgcgagtcgcaatgggactgcgtgtgccgctggcccctggcattgccaattgcgggtttgtgccaggaggaccctgtgtggggactgttccacactttccacatttgcttctctggtagcaggtgagctccgggattccgtcagcgctacctccgcgggtcccctgaagttatattttattatttgtatcaaacttgtctgtatatttaact

SEQ ID NO: 98890 - DNA, 242 bp, Homo sapiens
ggtcacaatttaaattcacaaccactaatctcaagtaccccaagtactacctggccatcctactatacttcgagtccactcttccaccctcctagctgaccacttcacaccttcccctctctcccaaactagcagcacatcctccctcttcttcactcccaccttgcttctgattccaccaaggaaacaggagcaatcctaaaaactcccacgtgattgctcctcccactgcttctgccacc

SEQ ID NO: 98891 - DNA, 322 bp, Homo sapiens
ttactattgttatccttattatttcctagaagatgactactcaaactgaaacaatcaatataattatctcaaagacagccttgaggaaagaataaaaattttcctcaatttcctgacataagctacacagggggaggtagcattggccagcgttgcacacacagggctgggcctcagccctggctccaccatgtgctagctgtgtcacgtcaaggcggaacctcggctctaccttgtctacattgttccaggataacacgttcgcgagggataacacgttcgcgagagataacacgttcgcgagggataacacgttcgcgag

SEQ ID NO: 98892 - DNA, 600 bp, Homo sapiens
ggcccgagaggcggcctcaggttaacttcaagcatgttgggctctccaggagggagaagaggcacctttgccgtgggttgaggactcctagaaccaacctgagactccgcggccatatacaccttacgacgtgtgtgtgtgtggcgggagatgggaggggaggaatcctgtagaacccagatcccatcattccagcaactgccagagcgttcgagaatgtcatgtctgtacctgtcttctctcatcttttgtgccaactgttttatcaaacttctaccccactttaggtcttccagtagatacctgaaaccctgaactacaatatatgtgaaatacagtgaatggcagaaatactttgataaaagatgtaaatgcctaccgactgcagaagacaacatcaacaaagcacacttcacaaaaagtacaacacaaatatactgcccaggttctaaaacatgtataagagttaacaaaatcagctgaggttgagcagaaattgtataggaaaaaataggaaaaacacagagaccaatctcagctgcaagaaggttcagctagacactgcaagcaaaagtataactcctgaaggtaagagacata

SEQ ID NO: 98893 - DNA, 408 bp, Homo sapiens
tgtttttttcccgaggtttaatagaggtgatgtcttcaaggtgctgggaggcctatcacaggtcgcctacgttgaccactgtcactggactaagctttcatgaaagctgcaatccctgctacaaatccctgaagtgccaaccttgccaagagggactgagaaagagacaagaggcaggatgtagggccctgggttctgagccatgttgctgcagagactggggttcaagtcctggtgctgctgtttcttggctgtgtgatcttagacaagtacttaacctctctgatccctcacttcctttgctgtgagagtgatatcgatggttattaattcacaggcttggcttgaggattaaaggacctttttagggtgcttgacacagaagttgaatctttgtgggcactcaat

SEQ ID NO: 98894 - DNA, 498 bp, Homo sapiens
ttaacatttactgtaaatttttattgtgcttaatgcctactgactgcatcttgtcataggaatctcctactggctctcctgcctcacccagatttgccaccaaattgtttatgttcactctttttcccatcttctatagactcccctgattatgttcatgctccccaagtctgaagcccctaaacttcacttctagtctgagttataaacctccaaaatatgttaagattacatttatttatagaggatgcacataatgaagatagcctttcgtaattaatcaggctacttaacatctcactctgaagcatttgcatttggatttccaaagttcggagtccccccaaagaaaatgagtatcaccacagtgatccttccaaagcaacaatccacctgaacgacaaactccatcattaggtggagctttagatccacaagatacaaatagtggtcaggatttcaccttccacaaaccaagggtagagaaatactgagttc

SEQ ID NO: 98895 - DNA, 163 bp, Homo sapiens
atgtgggccactaggcaaaagcatacattcaaaaaaaaattcctgtatttcccacagtatgagaaggtgcacaaatggagatagctggtcctacaaattctagggccctaaatagaacattcaaaagtctacttgggacattgattgcaaaggtggaggaaaa

SEQ ID NO: 98896 - DNA, 311 bp, Homo sapiens
gacgctaaagagaccttgaagagggtacaagacagggagaggcaggcttggccagggctgtctcgtgggaagttggctaaaaagccatcgaacacttccaggacaggaatagctcagccctggagaagactctggagagggaaagactcaaaaatgcccacatctgataccttcagtaagcaagcctttttgagtgcctactggctgccagacattgagggtatctaaggatgaatgatgttcatctggccttcaaaatgctagtggcagcagaggggaaaggcatgaaaacagataaggacataacgggg

SEQ ID NO: 98897 - DNA, 381 bp, Homo sapiens
ttgccttccctccctaacgtggtggtgttggtgttggtatgaccagcgtgcacacacagaagcacgtacaattacagagacaaacacgagagacacagacctgcaagcacacagagatacccaacacaaaccgctatacaacgtacatcagtccccctttatccgaggtttcactttttgaggtttcagttacacttggtctaaaaatatttcaatggaaaattccagatataactcctaagttttaaattgcatgccgttctgagtactgtgatgaaacctcatgccatcccactctggttggcctagaacgtgaatcccccctttgtccagcatctcagtgctgtatctgatacctgtctgtaagtcacttagctatca

SEQ ID NO: 98898 - DNA, 1276 bp, Homo sapiens
  misc_feature (1048)..(1048): n is a, c, g, or t
gtgcggctaggcgcgagctctgcgggagctcagcccccgggagagacccggcagcggcgcggcgaggacggcggcgcggcgaggacggcggggaccggggcagcccctgctcccgtggccagtgagataagtcgggtggagagtggcttgtgatacttggagtgtgcactaaccgtatccagtattgctcgaatgcgatgctaaggaaatgcttgtattaccacggtaatatgggttctttttccacgggtttgtggagtgaggcccacgagctggctcgtgtccgaaaccgagatggctccgtgtattagataccaatcatgggtgtggccttctctgttttatccacgccaggggggtgacccaccgctttacttctaaactggtattttcaaccggcttttgcaccttgtcaagtttttttatacggccattggagaccgaaaacttacaggtcccgaaactgtgcggccggggcggtcggtccgtgtctgcgcatttcaaaccgtctccggtgggttaattttcccccaaggcgaccgcgtttgtgtgggggaatcagccccgtaagggggcggtgcggttggaagttcaacacgcattgaacgcgattccacggtgagagttatccggaagtaagcgcgaggacaccttggggttgaataaccatacattggggggagaaaaaactccgcttgattcattctttaacgacaaagggttagctaggcagagagtttaggccccaacggtcggtttgagttcggcgcaggggatcaggcctcgttggttaaacgtccctcgaaggcgtacccattaagcggagatgtggctttgaaggggccccatcgaggaacatttgtggcgtagggacaaccgcgttggggaacgggccggcgcagaggtttttgcaaccggtggaagggcccaaattgcgaattcaacccatggcgagtttgggccaaccgtgccacgatgggcccctatggttgcgcgggaatccattacggaaggtttggaaaggaaaccttcccccgggttccttttnaaagagaaatagtcagtagaaaaagattattataaggaacagcgaaagtataagaaagtggtttgctggagcagcgagagagaaataattaaagtaggacgggtggtgtgtgagtaggtgagagaaaaaaacagggtggtggtttaatatatgaaaagagcgtggggggccctatgtttgtgggcccacccaacaagagatattattttttgtagtaagagaagacgg

SEQ ID NO: 98899 - DNA, 449 bp, Homo sapiens
gtgatagaagcttcagtgcacatatactatgctatcaataattcatatatgaacataatcgattttagtatttaattattgctaaatctccaccctcaaagagattacaatctagtctgaaagattttaacggtggccatgtcttacaggatcttacattcccagcacattatggatctggcacacagaagattctaacaatcaacattcatagaaatgttggttgagtgaataaataagtgaatgaattatgatttgggaggaaattgtgtagtaggtttataaattatcatcttttcaacacttaaaaaaatattcattattaatttgttggaatgatgaatgggcagggactttaaatgaattaatgtgacaagctgagttttccggaaagaaactgaaaaatggatgggccttttgggttaatttccactgccctgtctgtttta

SEQ ID NO: 98900 - DNA, 859 bp, Homo sapiens
catagctgaaacgactctcttaatcttccaccgctacacgagattagaggacacattattcgtgggtcgggaggaattcaatgaatcatgaagaaaagataatttataaagaatatgtattaagcatctaccacgtgccatgggaagtgctggtgtaaccaggaagatgaagaaaaaaatgcacatggtaaccaaccccaggggtttacagtccgatgagggagaccgacaaaacaccaagcaaatgtagaagtggtggtcagtgacttcaagtaaaagtaaaggagatggatgtgatgaaagacagtaacagaagttatatttcagacaggttgttcagggagggcctctgaggaagtgatatttcagtggaagcctggagggtgagaagatgatgggtaggtggagagttgggagaagaacaatcaaagccaaaggaacagcgtgggcacgcctgaggctgaagagcacccgcatggagaaacccaaaaggctgatgtgcccactggatagtgaaggagggagaagaaggtgtgagatgaaattggagaatggggaaaggcagtaacctaaatgactgcccacagtttgtacttgaaaacttcgcattgatttcaatcctgaacgtcttgtgatctggagttcccattggatttttggttataatgagtcagtgcatcaagagtaccttgaggccgttactggggtgggccttaaatgagcacacagagatgctatgcacatagtgagtatgtatgtatagagacgggatctcattctgttgtccactgcactccagcctgggtgacagagcaagactttctcaaaaaaaaataaaataaaattcagaaattacgat

SEQ ID NO: 98901 - DNA, 251 bp, Homo sapiens
ccgtgtgcttaagaaacgcccacacatacacaaggtagggagccacactgctcatcgcagaatccttcacgcgcctccacggggagaagtccacccgcacacaccaacgcctgcccaggtcaggcctggacaccagctctctgggtctctccaggaggtggtagagccataccccaagtttcagccatgtagttggctgggccttcaggctctctggggtgactggcactcaggaacaatactccagggac

SEQ ID NO: 98902 - DNA, 442 bp, Homo sapiens
gaaagacaacttcaaaatgatcaaaagcttttgatatttcgacttgcgtttgccccacttgccactgccctcccttgtgtgacagcagtagtgggaagagggaagcccacactcccagcatgagactctcattcctccttccagagggagcagagcagactttatttgtagatgatagtgtatgtccgctctaagctgtctgggagccacctgaaggacaaggtgctcatctctggtcttcctgcctcggaactcaggctggaaaagtggtggcactgctcaaaaacactgcaagccaaactaacaaaccacagatgtctgttccaaagattacaatcaaaacacacaatagacggcctaaggctcaggagcaaaagctggggagagtttcctggggaaattagaagcacctgcatgcatagggggatttataaacacaggg

SEQ ID NO: 98903 - DNA, 560 bp, Homo sapiens
gcctatctccacctgatccccaagaggatggtgtcctctcagaggacagtggggccccaggagcctcctgcgctgcccagctgggggtgcatgcagggcctggggagaggcggtgtcctgtggaaggctcctgggaggcgctgtcagagtctcactctcagacttcctcccgccgctgtgggaggcctggctgtgcccgcgacgtgtgtggcacagcgggctgggttgcaaaatatatctggcatggcagttggtgaagtagttatgcaaccaccaccaacttacggaaaccaccgagcgatgtgccttgctagcagaggtgcctggcttggccacgctggccacagactctggttccgtgttggcagtgtgaaaagtggcccaggctgtggagtgtcgagaaccatgacaggtcttccctgaagtcaccctgggagcacatgacccacgagaccccggcagagctggcatcttctcctccaaggatctccttcccattctacagaatccagaagacagcctcatctggttatcagcagccgatcctccctaggaggccc

SEQ ID NO: 98904 - DNA, 472 bp, Homo sapiens
tgaacttttttgctgcaattgttgagcgtcaaaggctgaaaccactattatcaccactattactgccctcctctctgcatttgaacaccctgctgcatcctgcatcttgcctcttcctttatacttgctgctttggatgaggtcccatgtatcatcctcagcccgggattttcaggctcctagaagacatttcctcttactgaggcatggacacgtgcaattgcagccaaaggtgaattggttgtcaggtgttccttcaacttggctcctctctgccctctcactgcctcctgccatctaatcagctctacttatctgccccttagagggaccatctcttcagttattagccattcttgtgtacacacaacctgctggttttcacttccttgtatttgctcagacagttttttccactaagaaggcagatgcctcaaaacccagatggacactgcctttcagaagctctgcc

SEQ ID NO: 98905 - DNA, 463 bp, Homo sapiens
gataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggct

SEQ ID NO: 98906 - DNA, 732 bp, Homo sapiens
gcatttagtcggctggaaccttgcagcgtcccacgcagcaatcaacctgatcggcagtgaggcagagcttcacactctccacctggctgaggctggaaactgatgacagacctggctgactcccagcgtctctaatgaatggatgcctggagaaactctgacctccataaagccagaggaaggggaaggggtgtcatcaggacttcagacacaaatcccctcctactccctacttcaagaccagataataattgctttgactgtaaattgagcttttctttttttttttttgagacagagtctcactctgtcgctaggttggcgtgcaatggcatgatgtcagctcactgcaacctctgcctctcaggttcaagcgattcccctgcctcagcctcctgagtagctgggactacaggcacgtgccactatgcccggctaattttttgtattttagtagagacggggttttaccacgttgaccaggatggtctcaatctcctgacctcgtgatccgcctgcctcagcttctcaaagtgctgggattacaggcatgagccactgtgcccagccccaaattgagcttttcaatctgctttcactagtataagctagagctccaagcagaaaggaaaacaagcaagacagaattgttgttagagatcagttagagatcggctattagagatcagtggcttaacaaattagggtttcaacaatacctatttccaattc

SEQ ID NO: 98907 - DNA, 385 bp, Homo sapiens
gcatttagtcggctggaaccttgcagcgtcccacgcagcaatcaacctgatcggcagtgaggcagagcttcacactctccacctggctgaggctggaaactgatgacagacctggctgactcccagcgtctctaatgaatggatgcctggagaaactctgacctccataaagccagaggaaggggaaggggtgtcatcaggacttcagacacaaatcccctcctactccctacttcaagaccagataataattgctttgactgtaaattgagcttttctttttttttttttgagacagagtctcactctgtcgctaggttggcgtgcaatggcatgatgtcagctcactccactccagcctgggtgacattgcgacactttgtca

SEQ ID NO: 98908 - DNA, 421 bp, Homo sapiens
cagagcatgagagggttcctgaatcgtgccaggactggtgccccagccttgcagctggtgagctgtggacccaaggttttgtgccacgtgtgtctggctctagaacacagtgacagagcgtgggtccacacacttgcacacgtgcatgcatgttctaacagtggagcttcgggcaacaagatggtccacagggaggtgtttttcactcaggcagcgtcaaatcccaccacagaggagccatttacactttgcccttctctgaaatctgcaggttttaaaaatctgagctttcaaaggcagctgtgctgagtgggaagggcaagtgctttggacaaaagtcaggctgagggccctcgggtgccagctccaccacctactcagacaggcagcggcctgccctgactccgtttcccctttgcta

SEQ ID NO: 98909 - DNA, 326 bp, Homo sapiens
ggtatatgtgcccaggctggtctcgaactcctgagctcaagcaatccacccaacttaacctcccagagtgctgggattacaggtgtgagccaccgcgcccggcctgattagttcttttaatttaaaaaatactgaattctatcttgcgttatctttcaaaagacggtgattataattcttctataatctctgttgtaaattctgattcctcaagtgggggttctcttggacttgacacctcctgtttgtgacttttttttcctctcagatttagctttttcccccaccagggtgtctccatctttgtttctgtcatagtgtctcag

SEQ ID NO: 98910 - DNA, 636 bp, Homo sapiens
tccagcctgggcgacagcaagactccgtctcaaaaacaaaaacaaaaacaaaaaccctgatctttcacttcgggcctgacagcagcttgactggaagtttgctcccgcagttctgagattctggccttttcttttgtcccattggtactttttgctgccagggtttcctgtccttcaggtttccatccccaatcagttgagagtccgactggagtacccaaggtgcgttgaggaatgaggcacagccctgggcttaactcatccagcctggccagctcagccttcccctgtcaggtgggagcctaggattgctgtcagcccagggagcagagttggaagaagggggcagggccctacctaggctgcggcccatcggggcagcctgcgctggtggcttcggaaggccctggtttgaggatgggtgcggcaggaacagcctgaagatagtggatggagaaggtacctgaggtgttgggagctctgctggtgagctgggcccttcacgtcaatgttagaggttgttacgtgctaggcgctgttcaagcactgggaattagctaaacaaaatgaccattactgtcatggagctcacccctagttgagaaaaataagccgaatcacacggcaagtgctagg

SEQ ID NO: 98911 - DNA, 792 bp, Homo sapiens
ggaactgctttcctcattatgatacccctgcatggaacagcacctggagagtaggtgttcaataaatcctcacttagaggttgagtacctactatgtacaagcaccatgcttggacttctcagcgtgtcttgctgaactagacacatctgctgtctttgtttgttcaagctgctttaacaaaagaccaaagagtgggtaatttataaagaacagaaatttcgagcttacagtcctggggtctgggaggttaatgaccaaggcactaacaggttcagtgtttggtgagggcatagtctctacttccaagatggcaccttgttgctgcattctccagaggggatgaacactgcttctcatatgggaagagatggaagggcaaaaatggacctatctagttactcccatcccttttataaggtcactaacccatttataaagttatatggtttggaagtcccacccaaatctcatattgaaatgtaatccccagtgttggaggtggggcctggtgggtggtgactggattatggggatggttttctcatgaatggtttagtaccatcctcttggtactgtccttgagatagtgagttctcacgagatctggtcctttaaaagcgtatggcacctcccgcctcactgtcttgctcctgctcccaccatgtgagacgcctgctcccccgtgaactcccaccatgactgtaagcttcctgaggcctacccagaaatagatgcccgtgttatgcttcctgtacagtgtgcagaaccatgagctaattaaacatcttttc

SEQ ID NO: 98912 - DNA, 1467 bp, Homo sapiens
aattaggttatgtaattatggaggctaggaagtcccacactaggctgtctgcaagctagagacgtagtgatggtggtagcatgactcagtcgaagtccagaagcctcagaaccaggaaaactggtggtgtaactctcagactgagatagaaggcctgagaaccaaggggccacgggtgtaagtcctcgaatccaaaggcctgaaaccctggagttctgatgtccaagggcatgaaaataaagctgtctcagctcctggggtatggcgttaggcgtggggggaggaagttagtggagagagaattagctttttctcttttccttctgtccaggctcctagctgtttggattgtgcgtcaatcacattgtgggcaaatcttccccattcagtgtaatggctcacataccagtctctgaaaacaccctcacagacacattcagaaataatgttttaccagttgtctaggtattccttaatgcattcaagttgacactgaaaattaactgtcacagggcctgactttatttgtaacagacttcagagtattgtagaaaacagtagagcaatcagtaacagtggaggttcaacagttgccaggtcattccaatagataaccagaagcttaaagaaaggatcagggaggccaggcacggtggctcagtctgtaatcccagcactctgggaggccgagacgggcggatcacaaggtcaggagatcgagaccatcctggctaacacggtgaaactgcgtccctcctaaaaatacaaaaaaatagccaggcatggcagcgtgcacctgtagtcccactactcgagagtctgaggcaagaggatggtgtgaacccgggaggcggaacttgcagtgagccgagatcgcaccgctgcactccagcctaggcgacagagcgagactctgtctcaaaaagaaagaaaggatcagggaaagagacaacctagataaaactacagacatcccttgtgatcaggaagactgtgcatgctgaaggctgccatctcagaggactgaccagagcagaacttctaaactacaagttcctggccaaatgaagggcaaacttgtaaactccttaagtagtgaaagcagtcttcaagccatacattaattagtcaagccaagtcactaaaggaagatgatcagtatgcagagatctgtgttacctaaaatgtccagtttcaacacaaaaattgagatatgcaaagaaacagaaaagtatgtgtcctatatgacagagaaatgtaggaaatataaagttttgagggataccaaatttaggataaatgctaagcagctgttaaaaatgtatgttcaaaaggctgagtgcagtggttcatgccttggcctcccaaagtctgggattgtaggcatgagccaccatgcccagccagtaagacccgtctagaataagaggcacaaaataatacaagcctgccaaaaaacaacaccca

SEQ ID NO: 98913 - DNA, 2541 bp, Homo sapiens
aattaggttatgtaattatggaggctaggaagtcccacactaggctgtctgcaagctagagacgtagtgatggtggtagcatgactcagtcgaagtccagaagcctcagaaccaggaaaactggtggtgtaactctcagactgagatagaaggcctgagaaccaaggggccacgggtgtaagtcctcgaatccaaaggcctgaaaccctggagttctgatgtccaagggcatgaaaataaagctgtctcagctcctggggtatggcgttaggcgtggggggaggaagttagtggagagagaattagctttttctcttttccttctgtccaggctcctagctgtttggattgtgcgtcaatcacattgtgggcaaatcttccccattcagtgtaatggctcacataccagtctctgaaaacaccctcacagacacattcagaaataatgttttaccagttgtctaggtattccttaatgcattcaagttgacactgaaaattaactgtcacagggcctgactttatttgtaacagacttcagagtattgtagaaaacagtagagcaatcagtaacagtggaggttcaacagttgccaggtcattccaatagataaccagaagcttaaagaaaggatcagggaggccaggcacggtggctcagtctgtaatcccagcactctgggaggccgagacgggcggatcacaaggtcaggagatcgagaccatcctggctaacacggtgaaactgcgtccctcctaaaaatacaaaaaaatagccaggcatggcagcgtgcacctgtagtcccactactcgagagtctgaggcaagaggatggtgtgaacccgggaggcggaacttgcagtgagccgagatcgcaccgctgcactccagcctaggcgacagagcgagactctgtctcaaaaagaaagaaaggatcagggaaagagacaacctagataaaactacagacatcccttgtgatcaggaagactgtgcatgctgaaggctgccatctcagaggactgaccagagcagaacttctaaactacaagttcctggccaaatgaagggcaaacttgtaaactccttaagtagtgaaagcagtcttcaagccatacattaattagtcaagccaagtcactaaaggaagatgatcagtatgcagagatctgtgttacctaaaatgtccagtttcaacacaaaaattgagatatgcaaagaaacagaaaagtatgtgtcctatatgacagagaaatgtaggaaatataaagttttgagggataccaaatttaggataaatgctaagcagctgttaaaaatgtatgttcaaaaggctgagtgcagtggttcatgcctgtaatgccagcagtttgggaggctgaggtgggtggatcacttgaggccaggagtttgagaccagcctggccaaaatggtgaaaccccgtctctactaaaaataaattggccaagcgtggtgggcgcctgtagtcccagctactcaggaggctgaggcaggagaatcgcttgaactcaggaggcagaggttgcagtgagccgagattgcgccattgctgtccagcctgggaggcagcgagactccacctcaaaataaataagtaaacccaaagaactaaaggaagccagatgtgaagaattaaggaaagtattctaatgtctcaccaagtagagaacatagagatagaaattttttttaaagaactaaatgaaaattctggagttgaaaagtacaataactacaattttaaaagttactagaaaggctcaatactagatttgagatggcagaagaaagaatcagcaaacctgcagattgatagaggatatgcaatctgaaacaaaaagtttgaagaaaaagtgttcttcacactatgtacacaaaaattaactcaaaatggatcatagacctaaatacaagcaaaaactgtaaaacttacaaaaaatgtaagtatttgtgataattctctaggcaaagctttcatagctgtgacaccaaaaacaaaaaagtgcaatagataatttgttttaaaagacagcgtttttattacaggaggttgtaaaactagtctgttttatctgtttcagattaatctcaacttaatttcagtaatgaaaaatttgctctatatgccttcattctgcccatgctgttattgtcacaaactacatctttataataattatatgtccatcaacatagttttataattacgcagttttaaaaatcaggagggaagaacaagagttacgaacagatatacattgtcttgctgctccaaaatctgcaatgtaaaaggccccatgcacaagggcaatgtgctaattctgttggagtcatgagtgagaggcccagaggttgcacctcacttggctgctcactgggtcttggatgcagggttcaaccacttggccagtgggaatggtgtgctacgatctgctcctttattttattttttgctcaccacacgggaattgtgatgcacccttaaataaagcatttgtgttccaaattaaaaaaaaaa

SEQ ID NO: 98914 - DNA, 545 bp, Homo sapiens
cagactctttcaaaagatggaagagttccaaactcaaggccagccctactctgatactaaaaccagaaaaagacattataagaaaagaaaactacaggccagtagccttgaggaaaatggatgcaaaaatcctcaacagaatactggtgcaccaaatccaatagcacattaaaaggatcacataccatgaccaagtggaatttatgcctggggtgcaaggatggttcaacatatgaaaatcagtatgatacaccacattaactgactgaaggacaaaaatgacacagtcataccagttgatggaggaaaagttcagtaccagactttgacaaaattcagtgccctttcatgataaaaacactcaaactaggaatagaagaaaattatctcaacataataagggccatatatgaaaagcccacagcaaacaacatattcagtgatgaaaaactgaaagcttttcctgtaagatcagaaataaggcagtggcggtgtgtgctggctcatgcatataagtccagtgctttggaaggaggcctcagtgg

SEQ ID NO: 98915 - DNA, 677 bp, Homo sapiens
gactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagtcactggatgaaccgaaagaacaccgagtgaaccagcaaatcagccctctgatacatgacagcacagaaaacagacgaaatcgtaacggagcgaacgactaaaagcatgaacggcgcccacagagagccaaacaactgcccaaaaacgaaccaccaggcaacaaaaatgcccagagcaacggacaagagcccaagcaaccaaagagaaaacaggcaccaggaacagcgagag

SEQ ID NO: 98916 - DNA, 650 bp, Homo sapiens
tagtgatactaatgtaaacacacctgtgctgccagtcatagaagtatagcacatacagttatttacagcgtataataccgtcgtgcattgcttaatgatgggatgcattctgagaaatgccctgttaggtgatgtcattgttgtacaaacatcataaagggtacttacacagacctaggtggtatagcctcctattacccctacgctatatggtatggcctgttgctcctaggctacaaacttgtatggcatgttactataagagaatactatatactgaatactataagagtgattaacacaatggtaagtatttgtgtttctaaacatagtgaagcatagaaaaggtacagtaaaaatgcaatataaaagaaaaattggtacacctatattgggcacttgcgggactggaagttgctctgagtggtgactgaatatgaagggacattattgtacatcactgtagactttataaacacacttaggctacataaaaagtaaaactttaaaattcttaacttctgaatcttttgtaataacacttagcttaaaacacaaacacggcaacctgcccgggtccccttccacactgcggaagctttgtcctttcactcttcataatgaatccttctaccgctccaaaaaaaaaa

SEQ ID NO: 98917 - DNA, 961 bp, Homo sapiens
taagtgaagattgttttgatatcatcagcatctgctgcaaacttaaaccacttttgggactttcttttctcttttgtctctaccaaacttttagcatcattccctgattctaaatacattttccaccttctttttacatgtcttttacaaatttgagctttttttttaagttttaaaacttttataagttcagtgttgtcactgtatgtttacatattcattgatacaatttacatcgagatttttacttatccatttttgcagatatgtacacaaagatacatattcaataactgagaaacaagtgaaacttctgatctatactttcaggtttgttcgatcatgacacttctgataaggatcatggacataccagtttcacctcttccagaaggacgtcgtcattttatcttaagagtttactctgggttttattgccgaatacaaattccctcaatcgcttttttcttgcaggtgcctttttccataattttttcttataaccagcccttctcatccaaaggccacaatgaagtcgaagaaacctatagatgacagctttcacaatccttctcttgccttttcctgtactgacgtatgttagagatctggctggcagcttcaagacacttggaagcaagagggccactctattaaggatcgctgaagtatgcccacatgtcaggtttctctcagatgtggtaagtctgggagtggaggaaacaactggtgtctgaatatgactaaaacgtccagtggacaatgcagaaataagagaggcatttttgacacagttttggtaggctgaagatgccaaaatattcagaggccataagattcctgaagctgctctcactgcaccggcaaaggcagaggcagctatctcgtcatcctccaaatttgagctcttattaaagagttttctgcgtgctctgctatattttttcaaaaggtccctcca

SEQ ID NO: 98918 - DNA, 984 bp, Homo sapiens
taagtgaagattgttttgatatcatcagcatctgctgcaaacttaaaccacttttgggactttcttttctcttttgtctctaccaaacttttagcatcattccctgattctaaatacattttccaccttctttttacatgtcttttacaaatttgagctttttttttaagttttaaaacttttataagttcagtgttgtcactgtatgtttacatattcattgatacaatttacatcgagatttttacttatccatttttgcagatatgtacacaaagatacatattcaataactgagaaacaagtgaaacttctgatctatactttcaggtttgttcgatcatgacacttctgataaggatcatggacataccagtttcacctcttccagaaggacgtcgtcattttatcttaagagtttactctgggttttattgccgaatacaaattccctcaatcgcttttttcttgcaggtgcctttttccataattttttcttataaccagcccttctcatccaaaggccacaatgaagtcgaagaaacctatagatgacagctttcacaatccttctcttgccttttcctgtactgacgtatgttagagatctggctggcagcttcaagacacttggaagcaagagggccactctattaaggatcgctgaagtatgcccacatgtcaggtttctctcagatgtggtatcaaaacatcattatgggccgggcacggtggcttacgcctgtaatcccagcactttgggaggctgaggcaggcatatgaagaggtcaagagatcgagatcatcccggccaacatgaaataacaagaaagttagaaagtcttctgcctcccatcagaaaatgagctcaagtgttgtatccattgaaaatgacatctgatgctaatcatctctgagtgaaccctacatcttacagtaaattgcatattgcaataaaaagtgatctctcatggttcttgaatt

SEQ ID NO: 98919 - DNA, 282 bp, Homo sapiens
gaggaaggacgctgctgtggtttccaagatgggctgggggaaggggcgcgcagaagccggcccagcgctgtcgctcagcagctggggcaggaagcaggctgtgctgggagtctggcaggtggggatgaggctcacagagaggagaggccttcaacgccgggtcatccggtgtgcacacaatcaactctagccaggtggggtctgcccttgagactgggccccagaccaggcccagcccagcccactctgatcatctgaccaggccaggcacgtgccccaggc

SEQ ID NO: 98920 - DNA, 265 bp, Homo sapiens
tgggaagttctctaacttaaaaagtcacactgaagggtggagctaggatatggcagaatacaactcagacactgaagggctttatgtgaatcacccatcccttcagcttccagtgacctcagttcttttttttttttttttttctttgagacggagtttcactctatcgcccaggctggagtgcagtgatgtaatctcgcctcactgcagcctccgcctcccaggttcaagcgattattctgcctcagcctcatgaggagctggg

SEQ ID NO: 98921 - DNA, 517 bp, Homo sapiens
tttttttttttttttgagacggtgtcttgctctgtcgcccaggctagaatgcagtggtgctcactgtcagctccacctcccgggttcatgccattctcctgcctcagcctcccgagtagctgggactacaggcacctgccaccacgcccggctaatttttcgtatttttagtagagacagggtttcaccgtgttagccaggatggtctcgatctgcctgcctcgtgatctgcccgcctcggcctcccaaagtgctgggattacaggcatgagccaccacgcctggcctgtcactggtaatttttaatcatgatttttcttctctgtggtgcactaaggaatagaatgttgctttacagcttttcctcttaccttgttcctgaatgaatagtccaaggtatcttggaaaaacagagtataattaggctcctttctatgccttctttttctttgttcatttatacctagaaggcagtgttttaaagtgtggtccatggactacctgcatcagattcacc

SEQ ID NO: 98922 - DNA, 683 bp, Homo sapiens
agcactgaggctggtgagccaggcagaagtcagagtgggaggagccttgaggtctctccaggagattcagggaccataggatttggtagtgattcagctatagagtgaaaagatgacagtggccatatccagggtaatgtctacgggaatttgtgaatatccagatatccagataagagaggatgatggccctaactcgagtaccaaaattggatttcctcagatacttattcaggtgagaaatgattgagtcttgtcttggtgtcctgtagagagaaatgctgtcttctgggaccaccgccctgagcttgggggcccccactagcattcaggttcccgggagaaaatcctgaagaacgggggtcatgagcaggggacgtgtctgctatctgggtaagtgattgtgtgcaccataaacttaccacggacaacctgatcttcacgtttgtaggtcagtgaggttcctttccctgaacagtttaccatgtgatgcgtttatgggtattccggtaagaaagggtagtggctcctcgttctccttgccatgtaatcctattgttttctgtcttggagagaacgtatgaggtaagtaccctgtgagtgctgatggattggcacgtaaccagggaactccagtggcactgtgcatcacaggagtaactaaggtggatgtgcagagaaga

SEQ ID NO: 98923 - DNA, 399 bp, Homo sapiens
cctgaactctacaggctcctaaataaagaacctaaaattctgaataaaagaagtagagttggagcccagagacagagtgagctcagaacgcaagcttgacagcaagacaaacaaattcctcaaatgagactgccagccagtatttgggctataaagcatggccaatttgctttctcaggatggagaatataatccccagaagcattatcgagggcacttttgagtgcctgattccatgtctttgaacaaacaaagtcgccaactacagttcctctctcaagagcaaaacctgaaatttgtcaagaaatagtggacttttgctcttgttgcccaggctggagtgcaatggcgtgatctcggctcaccacaacctccgcttcccagattcaagtgattctc

SEQ ID NO: 98924 - DNA, 710 bp, Homo sapiens
atctgtatgggaggcccatatctgggctcaccagccctgccatctttgtcacagcctctgtccaggccaatgtgtcctccagctcagcttactccttcattcattttttcaggaaacattcaaggaccttcttccaagggcacaatactgagcaacatggacaaggtctggccctatggtaaagtcaggtctggatcatggaattgaatggggtgtgttgccaggcacccgcatgaggggctggctcctccccgtgaattctgggcacagacacccagacctgagcaggcccctcaccccacagcgactggggagccggagcccgagtccctcccacctgctccctcggtttctgagggtctgtctcatcctgcagctggacagacgtgatcttcagccccaagttacagacgcttagagaagctggagacttgcacaatgtctcagaggaaagagagccagaacctggacccgtgttgtaccccaaccaaaccctccatggtggaaggaataggagtgggaaggggaggaggagacatatggtccaggaggttccatatgtacccacacatggacctcaaagaggcccccacagcaagacagcaaatgacatccacagtcacagatcacggagtgatttcagatgaagatggtgctggcagtttccccatcagcgcaatggagtttgagcaaaggatctcactggagaa

SEQ ID NO: 98925 - DNA, 443 bp, Homo sapiens
acccctgagaaggtagtaggaatcccattgagaagggacaggaacctggacaaggtgaaggcactggggttggaggtgggggctcgggactccaggtactgagggcagtctagggcgtggtggagagtttgccatggaagtaagcaggagggagtctgctcttaaccacaaaagttgatgttctgcagggctctgttctaggcagtttgctttgtttagactcttctgaaacaaccatgtctgctcccatggcttcagttatcatcggataacagtgcctaccaaacctttatctctagcccagatctcccaggtcccaggcctgtgtctccagctgtgtcccctgtgcagttttacccagttatgacacagacaccccagactcaacttgctctacctacttcctgccccaacactgaccttcctgcagcttccctcaccct

SEQ ID NO: 98926 - DNA, 708 bp, Homo sapiens
  misc_feature (18)..(18): n is a, c, g, or t
  misc_feature (39)..(39): n is a, c, g, or t
ccggttaagctagagggnacagtggctgcctatcttcanataaaataaaaatcaaaaggaactttccaccatttcattgaacctgtgagtgaaaatgatcccaaaagttagagaaaacaaagaacaaatcgggcagcccttagaaccaaaacagttctgaggagctcccaggctgcaatgtggtgcgaaatgttttatggacagaaaatggaaatgaggtgcagaaattggagacggaggtttgctcttgttgtccaggctggagtgaaatggcgtgatctcggctcactgcatcctctgcctcagcctcccgagtagctggaattacaggcaccctccaccatgcccagctaatttttgtattttcagtagagacagggtttcaccatgttggccaggctggtcttaaactcctaacctcaggtgatccgcccacgtcggcctcccaaagtgctgggattacaggcgtgaaccaccgggcccagccaagtgttttaatttttaaaaactatttgaccatatgaaaatatagatgttccattaaatatatatagcctaagaaatataatcagcaatgcagtaaaagattatgtatacggatgctcctgacagttggatttacaatagggaaaagctggaaacaacctaaatatttgaaaaaagagaatggtaaatacatcaaaaatacaataaatacagtgttaagtg

SEQ ID NO: 98927 - DNA, 422 bp, Homo sapiens
gcgagggaaaaggtttttcagttcctcaaggtattgaaaagttgaatatgaaattgaagttagttgtatgagaaaactgagatatagaatgattacgtgactagcccaaggtcacacaactaataagttcaagacagtggagaaaggatttcagagttgatactttacccataagccttaaccacgatactgtgtatcatgatttgaaccacccaactactcagtgaagttagtgatactgttctctttttacagaggaaattgaggttcatcatgcttaagaaacttattcagggtagcaaacctagcaagtgttagaagtaggattccagctaaaatgtatctaattctaaaacctctattctttacattctaccaccctggctcttcaaaatttataatacaatttttggtgaaagggt

SEQ ID NO: 98928 - DNA, 242 bp, Homo sapiens
gttttgtttgtaccctagtggcacctagaaagccagcgagacagaaccgttcactcttccggaaagggggctgaaaccagggagccgagtggtattgctcagcggatctcactcccatgaagcccaacaagctaagatccactggcttgaaactctcactgccagcacagcagtctgaagtcaacctgatccaaggctgaattctgcagtttttggcttcattccaacttgaatttatatag

SEQ ID NO: 98929 - DNA, 492 bp, Homo sapiens
acccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatatgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagttattaggagctcaaaggagaagggccagggatgggctccttgtcccactacctattgtatcatgaccagcagctgtgaaaatccctagacacctccc

SEQ ID NO: 98930 - DNA, 397 bp, Homo sapiens
gtccctttggcagcgtgtgtgggaaggactagaggctccgaggaggctggagcagctctgagtaggcgaggccggcactcaggccccagcagtggaaaaggaacagagtcagggggactagaggaggctggatggaggggaaggcagggtcaaagccaacaaaagcatgttatataagacccaacagagagacagcatcatccccagacacttcgcccccaggggctgacccggaccttggctaagggcagcggcccaggcccaggcactgcttccggccagcctggtctctctgcaaagtccaggggagcaaagaggaagccacacagcagggtgaggggtggcagaaggtggaacccctccatcccttcactcttggcatctacagccacttccc

SEQ ID NO: 98931 - DNA, 317 bp, Homo sapiens
tggatgccaagaggctgcccaagccctccaaggtcaccctccctagagcattccagttaagactggactgggctcgtactgccgggtcaggagacttgatttcaggaaacaaagtccaactctgggcaggagagggtagaaaagtcaaagggcaagagcctagagacacttctacttctcaccacattaaaaaagacacattttgttttcatacatcatcatttgtgggggaaaaaatgtttaaaatctcacccctataaacaagaccctgtcaagctctgattggagaaatggaaatacatgcaacctttccagaa

SEQ ID NO: 98932 - DNA, 525 bp, Homo sapiens
ttttttttttttagatggagtctcactctgtcacccaggctggagtgcagtggcacgatctcgactcactgcaacctccgcctcccgggttcaagcgattctcctgcctcagcctccagagtagctgggattacagacgctggcaaccacggccggctaatttttgtatttttagaagagatggggtttcaccatgttggccaggctcctgacctcaggcgatccacccgcctgggcctcccagagtgctgggattacaggcatgagccaccacgcccagtcccaataaatcctactcttctaactggccttgcttcaattccgccacccagcggctaagtttctagctagagtttgcatttatttagtgaactcaatgtgctgggtgctctgaacactcacctgctgggttgtatatttaatcctacaacaactcagtagtgatagatagtattatccctgctctgccgatcagggagctgagtctaatcagctggtgagtatgtgatccaaccctagccatac

SEQ ID NO: 98933 - DNA, 892 bp, Homo sapiens
ggcagatgaatgaaaaagcacagtgcagttcattcatacaacggaagactattcagccataaaaatgcaggcacttctggccggtgccgtggctcacgcctgtaatctcagcatcttggaagaccgaggtgggcggatcacccgaggtcaggaattcgagaccagcctggccatcttggtgaaaccctgtctctactgaatatgcacaaaattagacgagcgtggtggcgcgtgcctatactcccagctactcgggaggctgagcacaagaatcgctggaacccgggaggcggaggttgcagtgagcccagattgtgccactgcactccagcctgtgtgacagagtgagactccatgtaaacacaaaacaaaacagaaccaaaaaaataaataaataaataataaaaaaccgaaaaagccaggcaggcacttctgacacaggctgcaacatggatgaaccttgaagacattatcgccagtgaaacaaataaatcccaaaaggataaacacgaccagcctccgtggctcgcacctgtaaacccagcactttgagaggccgaggcaggcgtatcacttcaggtcagcagttcgagaccagcctggccaatatggtgaaacctcgtttctattaaaactacaaaaattagctgggcgtggtggcgcacgcctgtaaccccagctacacgggagactgagacacaagaatcgcttggacccacgatgtggaggttgcagtcagccgagaccatgccgctgcactccagcctgggtgacagagaaagactgtctccaaaacaaagaaacaaagaaaattaaacacggtatgattccccttctatcaagtgtctagagtagttaaactcatagagttgcaaaatagaacggtggcccc

SEQ ID NO: 98934 - DNA, 373 bp, Homo sapiens
caggatatgcatttaattgtcatatctccccagtgatttgtgacaatttctcaactcttgtttttcatgacttttagagtcttaagaaagtactggctgggcacggtggctcacacctgtaatcccaatactttgggagaccaaggtgagtggatcacctgaaaggtcaggagtttgagaacagcttggccaatgtggtgaaaccccatctctattaaaaatacaaaattagctggtcatggtggcgggggcctgtaatcccagcttcttgggaagctgaggcagaagaattgcttaaacccggaaggtggaggttgcagggagctgagatcgcaccattgcactccagcctgggcaacaagagcaaaactcc

SEQ ID NO: 98935 - DNA, 535 bp, Homo sapiens
ctttacttaaaatctctctcaatgacttcctaccatcctattaatgatctgatttctactgacctctccaaacatacctccaccagctttgtcctagtaaagctccagccacatggcctcctccagatcttgcaacatgccaagttttttccacctcagaacctttatacatgctgttcattctggctagcacattcttcccttcactttgtgtatgcctgcttccttttcttccttcagtttcaatgtaatacctcttgaaatagactttccttggacaccatatctaaactgaactctcaatctgtattcctgtttttctctattacccattcactgatctttccttctttgttcttcagcatattcccaatagatagagccatgtctggcatacagtagaaagactaaaaatgatttaggaaggaagcaaaaaggcagggaagctgtctataggtgtaatatatgcagactattttgatgtgaacacaaggttcttattttctctaaatttcaccttcaacagcctaacacc

SEQ ID NO: 98936 - DNA, 321 bp, Homo sapiens
aataattcaagaatttattttgtaaaatcagaggtaaccagtaacagtaaaataatgtgtaaccaccaaatgagtaaagggggcggggtggaatggtataattaaaaaaacaaaatcttttcccaaaaggcaaatatgagactattttaaaagaacaagaaacaggtgtcatctatagaatagtaaataacaaaacatagaaatatatacaaatatattgcagtgacagtaaatgtaaataaactgtttcaatttgaagacagtaattttcaggttaaaaaataccacttctccttagagacatacatataagaattcagg

SEQ ID NO: 98937 - DNA, 673 bp, Homo sapiens
ctatacttatcacttttagtgctgacattccaactggagaaatgagacataagcaaaagaaaaacaaaaaatagttcaaagcaatgccaaataagcggtgcaaataataaaccctccagaaaagaagagtttgctgtgagttagcatgatttggaaaacgtcaattcacatatgattcaagaattggactagatgttaggtatttaagtcaggtatgttgtatttcagtgcaagggcaggaaatagtatagcttttgattagagcttaatgttagccacatctgtcaatttatgtaatatacatatgttattgtgtctaaaatggctaaggtagtaatcccgttttatgtgccaatcacatctacaaagggccattctgtttgtggcacagcatttcaagaaagattggcagatttgttaactggaccagagaaaggtgaccaagatgtatgagtcttagaaaccatggctcaggaggattggatgaaggatttggtagtatttgactggaaaataggaaggagagtactggaaaataggaaggagagtacctgggtacatgacaactatctcccgtgtaatagacctagaaaagatagatagcagtgtgggctgttcttaaaatttataaccactgctattaagtaggctgccctgcagttctaccataggt

SEQ ID NO: 98938 - DNA, 559 bp, Homo sapiens
ttattgcagcactattcacagcggtcaagattgggaagcaacctaagtgtccatcaacagacaaatggataaagaaaatgtgatacctatacacagtggaataccattcagccataaaaaagaatgagatcctgtcatttgcaaatgtgggtggaactggaggtcactatattaaacgaaatgaaacaggcccagagaaacaaacttcacatgttttcttttatttgtgattgctaaaaactgaaacaaaggaacctatgagttttatagattccctatctaaagataaagagtagaatcaaccttcccaggaaacataatcaggctttggcaggggagtggggactggttaaatgggtataaaaatatagttagctagaatatatacaatctagtatttgatagtgcaacagggtaactataatcaacaatagtttattatacattgaaaaataactaagagtctaattgcattgtttgtaacacgcagtaagggtaaatgcttgaggtgatggagaacccatttaccttgatgtgattattgttcgtggtgtgcctg

SEQ ID NO: 98939 - DNA, 491 bp, Homo sapiens
ttcttctcctaattatgtctccttacgttaccaaaaaccacccaataaatatttacattcactggaagatgtgtgactgtgcacaggatttttaaaaattaactaatttaacaggtgactggcattgatctgagacatgtttttccaccactcaccccattcccaatgcctttgctgaccttagaaagttacttcccttctctattcatttccctatcaaaatccacactaaggctcagcgaggcaaattgaatgacacaagtgggttcactttataaaccacccccacataaaaacatgagaagctaaatatatgtaaaatgccagcctaattctggcctataatcaagattttgtaatttaatgattttttttttataacaagataaaatctccctgttggtttgcttcctaaacagagcaccaatcccattgtctagcccatcatcctccaaaaaaggaccttggagaaataagatctgaagttctgt

SEQ ID NO: 98940 - DNA, 165 bp, Homo sapiens
agtgccaggtaccagtgtcctttccctggtgcagcagtgaggcaggaagctgatggttgggtccccagcccaccacgctggagctctgaggctcctcactcaccctccttagactcatcattgtctcaacccaaagagagacccgagccacctcgtgcacccact

SEQ ID NO: 98941 - DNA, 783 bp, Homo sapiens
gaaactcagtagctataaaggaaaagatagatgtgctagttacttattaattaacgaactactacaacttaatgttgtaaaacaacttttaatattatcacttccttcgtttttcataaataacatctttaactgagaatatgtttattaacctaatatcatttcaaaataaaatgttatacttaatctcaaaaacaaattcctagaaagccgttttcaaaaaatgtataaaatagacctatttatcatgacaccttcaggtgtgtaatttgatttgccatgaatgtatacattaatttttaaataattttacatttaacatttgggatgtggaatggatttattttgtatctaagtacatgaattaagtaataaacagtaattattggcaggagcgtctagagtttaaaattgtgtttctttacaatatttcattttttaaaatatatttttccatattaatctgtgaaaaaatatattaatgaaaaactgacgcaaaggaaatattttaaaataatattttttatttcagttatacaaatacttggctagatatagtttttattttgacatgttagaaggatagttttgaggtaaaagtaattctttattaaatatttttttcttccatttttgttttgttttgtatttttgagttggggtcttgctctgttgcgcaggctgaggcaggagaatcacttgaacctgggaggcggaggttgtggtgagccaagatcgcgccactgcactccagcctgggcgacagagcgagacactgtctca

SEQ ID NO: 98942 - DNA, 490 bp, Homo sapiens
  misc_feature (444)..(444): n is a, c, g, or t
  misc_feature (452)..(452): n is a, c, g, or t
  misc_feature (454)..(454): n is a, c, g, or t
tgatgagtaaatcttggcttctttataaactggtcttaaggtcactctgtgaagagtggctacaagccaagatggctgctttttagaagagccctgatgggcaggccgtcaggttcctgtgtgtcagtcaggtgagatacaatgacaaaaatgagaaggtgaaaccaaacgcatgaaacagaagaaatttattacttacagatctgacagcttaggggtactgatggggagcgcagataagtctggaggtggcagggagctcagcagtgggtagggagtgagagagcagctatgggagaatctaagtgaatgactagattgtaaaagtagtttgggtataaattgcagaggcctgtgaatgtcatactgaacacactcttcaggcatatgagacgagagcatgacacccatgcttgcacttggcgtgctgggacactgtgcaantagcctgncnagattactcatcggtacagagctcgattctaatctt

SEQ ID NO: 98943 - DNA, 148 bp, Homo sapiens
ctcaggcccctgccatatgaaacgcctgttttctctttgctttctaccatgattataaacttcctgaggcctccaaggagcagatgccagcaccatatatcctgtaaagcctgcagaatcatgacccaattaaacttcttttctttat

SEQ ID NO: 98944 - DNA, 431 bp, Homo sapiens
tcaattcagaattagtaactattatcttcctaataaactatttcagaatgttttttagatatttagaactgttgcaaaaatagaacagacagtttctatataccttagaccaaagttcctccattattaatgccttacattagcatggtacatttgtcacaattaatggaacaatattgatatagtattactaactaaagtctgtattttcagatttccttagtattttacctaaggcccttttgttaatgccagggccccatccttaccatatgatattagctgttacatctcctaggcaactcttggctgtggcagttgtaactatcaatttctgaacacttactctttgccaggcacactgggcttcttatgtgttagcttccaatcaccacagaaatcagagttgtgcattattactgcatttttca

SEQ ID NO: 98945 - DNA, 730 bp, Homo sapiens
cacgctcggataaatttttgtatttttagtagagacggggtttcaccatgttagccaggatggtcttgatctcctttcctcatgatccgcccgccttggcctcccaaagtgctgggattacaggcgggtagtaattttaaatgttacagccatatagaaatagtatagaaagtaggccagcatcatcctgaaaccaaagcctggcagacagacaacaaaaaagagaattttagaccaatatccctgatgaacatcaatgcaaaaatcctcaataaaatactggcaaaccgaatccagcagcacatcaaaaagcttatccaccatgatcaagtgagcttcatccctgggatgcaaggctggttcaacatacacaaatcaataaacataatccagcatataaaccgaaccaatgacaaaaaccacatgattatctcaatagatgcacagaaggcctttgacaaaattcaacactccttcatgctaaaaactctcaataaattaggtattgatgggatgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaagagaaggaaataaagggtattcaattaggaaaagaggaagtcaaat

SEQ ID NO: 98946 - DNA, 345 bp, Homo sapiens
ggttttgtagaaattactaaaaatgattttttgactaaagtctccaatctgccaggcactgtgccagcagtttggagaagagcaaggcatcttggccccagaggacttcaaagagagtgggagaggctggtggctatttatagtccttttggtcacttttagagggccttagaaagtaagacaagggcgtgagccattctgtgggaggcagaaggtgaccttgatcttattggcaagcaggagttttccctctaaaggggaggcagggcatttgagagagagaacagcaagtgcaatgataagtagctcagcttgtgaaaaagcaaagcaactattaactacagg

SEQ ID NO: 98947 - DNA, 356 bp, Homo sapiens
ttggaaatctctttcgcatccctcctcaatcctattcatttcccttgcttctcagaggaaaaacgatttggatcttggtgtgtgtcgtgccctttaatttggaagtatttttgcaggaaagaaagtttattcatgcaacccttaactcttttgcaatcacaaaaagagagagagagagagagagagagggctgggcacagtggctcatgcctgtaaccccagcactttgggaggccaaggtagaagaatcccttgagcccaagagtgagaccagcctaggcaaaatgatgacacccctgtttatacaaaaataaaaataaaaataaaaaaaatcacacctggccaacatggtgaaa

SEQ ID NO: 98948 - DNA, 323 bp, Homo sapiens
gtttgaggccggctgggcaacatagacaccatctctttaaacaaacaaacatcattagtttctacattctacaaggtgaaagactaattagaagtgaaaaataccactgaaatgttggtgtacaaatggcagcataatttgatttacactagattttacacatttgtgtctatttcaaataggtacttttacatttttcttaactgcatctgacacagagtgaatcacagatatatgttggtgtcgaaagcagaggttactattattaaacgaaattttgtgttttgaagttattttgttttgtttttttgagacaagatgtc

SEQ ID NO: 98949 - DNA, 319 bp, Homo sapiens
catcccatttgcacccagcaccatatgcgtctcgctcactgtctgcttcctccactacggcagaatctgcctggggacaggaatgtctgtctgctttcagtgatgtatgtcactgacgtgtatcccaagtctagaacgctgcctggcccacaagggaaattcaatatgccttttttaaaatgaatgaatacatgaagaatgaataaatgaaacccatgccacctcccagatcccatctcagggagagccacatcacctactcagcagccttgtcctaaatcctccctcttcctccccctgccctgaactgcccatcagt

SEQ ID NO: 98950 - DNA, 461 bp, Homo sapiens
gtaagtcagccctattcacctgggaggaaactagacaaggatgtgaatactaggaagttagattcattcaggggcatcctggaggccagcgccaaaatgataatgatgatgattatgattatcagtattacttctttggttccttcagacccacttatcttttctcatttctccaaggattttctttttcccaagatatggctttttgagattgcctagcctcgctttttgagattggcagagattttggagaaaggtattaagaataatctagctacattttttccatgaataaacagctaaatttgtccatctacaccttcctatcctaacgtagacctaaaactgtaagaatgcttgttttggtagtgaaagtgtgaaacattttctatttgctggactaagaaaagcaaaattctctaatttaggaaaaaaggttatgtgccccaatgtctagtttc

SEQ ID NO: 98951 - DNA, 1091 bp, Homo sapiens
  misc_feature (76)..(76): n is a, c, g, or t
  misc_feature (87)..(89): n is a, c, g, or t
ggaggaggcgcacgaatgatgtcataggcgatgaccgggttgttatttcatcacgagggcgcttctggaggaacgncgcgatggctnnncggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttgctgatccttgatccaatttagactgtgcccctcaacatacgggaaactggtggctgctccaccctcgtaaaacaaaatcgtttccttaaaaaaacggttttggggaaaaaagctccacttagtcctatacttttcaacaaagttatat

SEQ ID NO: 98952 - DNA, 748 bp, Homo sapiens
aaattagagctaagtagagccggtgtttgcgcttcgacatctttccacgcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcaggtgcctaactggcatagagatctggtacgagtgtgtgaaaacatacacattgtgttgtgtgcgcacaaagtggataattaaggacaggaacagtgacaggcgaaatccattgtatacaccgaaagaagatcttcacgtatacacattctgcaaaagtactaaactttgaaagcccttctacaagcagagaagacgtgtgtcaggtctgtcccgtccatc

SEQ ID NO: 98953 - DNA, 294 bp, Homo sapiens
gcggccgcctactactactactgctcgaattcaagcttctaacgatgtaaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaata

SEQ ID NO: 98954 - DNA, 2534 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98955 - DNA, 2534 bp, Homo sapiens
gaccagctgcctgagtagctgggactacaggcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98956 - DNA, 2159 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaggttttgaacgctccttctttttgggccctgc

SEQ ID NO: 98957 - DNA, 2496 bp, Homo sapiens
  misc_feature (26)..(26): n is a, c, g, or t
aagagagtacaacctacggctaggtncgaggctgggtgttgcttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98958 - DNA, 1675 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggcccaaaaatcacctcacgggggcgacaaacaatgaaatgccacacacacccgtgtgagtctgtgaggaaaagggaaggcagcactcattaagggcgtcgtatattaaaatcaacaaagggcgagggggcgtctgtgatcaaaacagacccacggagggacggtgaggagggacaaacacaggctggacgtcagaaggcacttctagtggagaaagacggcacaccccccaccccctgggggggcgggaaaaacgacgaaggtccagacacccccacggcaaaaagataacaccggagcgcggaactaaagaaaaaaacaaccgacgagtagacaggggcgcacaaacccaaacagtaaatttgccggaccgaaaaaaacagtacccacgagacgtgaataacaacaccatcacggccgttgcaatcatgg

SEQ ID NO: 98959 - DNA, 1300 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatacaataaacaaaaaaaagggggcgtctaagatctgagggccaagttaggtacagttctgtcaggggccatggaggattaaggaggggggggttaaagggatggaaagtctggtttggggggctttgggggattggaccagataagtgataatagtagggtagttgggag

SEQ ID NO: 98960 - DNA, 1338 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatacaaacaaaaacaacacacaccacaaccacaacacaccacacaccacacacacacacaacacaaccacaacaaacaacaacacacaaccacaatccaacaccccacatcctacccccctcaccactcaccacctcacccccgccccccacctcccccaccacaccctcccccactcccccccccctcccaccaccccacccccccct

SEQ ID NO: 98961 - DNA, 1144 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttgctgatccttgatccaatttagactgtgcccctcaacatacgggaaactggtggctgctccaccctcgtaaaacaaaatcgtttccttaaaaaaacggttttggggaaaaaagctccacttagtcctatacttttcaacaaagttatat

SEQ ID NO: 98962 - DNA, 2758 bp, Homo sapiens
gggcggctgagtaggtgggtggtgcgggcccggccgggccggggcaggagacgggcgtggggtcggcgctagcccccgcgaacccccgtttcatcctccgctctcatccccgtcccggtcccagtcccgttcccatccctacacctccggccgccgttccccgggccccgccgccccggatgccggccccgcccgccgccttcccgctcccaggcctggccgccatggcgccgcgggcgggaggcctttgtggggcgggcacgtggggcgctgggggcgcgggagcggggccgccatgggctgcggggccgcgcgagcgctcgcctccgtcctctgcctccgcaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98963 - DNA, 2464 bp, Homo sapiens
  misc_feature (15)..(15): n is a, c, g, or t
taggctagagaggcngggtggtgcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98964 - DNA, 2464 bp, Homo sapiens
aaaacatagagctaagagcgaggccgcgtgttagggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98965 - DNA, 943 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggtacagaccgagaacaaggccatgtggagatagaggcacagactgaagttgtaccac

SEQ ID NO: 98966 - DNA, 2488 bp, Homo sapiens
gaccagctgcctgagtagctgggactacaggcgccggcgtcggctgcgtctccggcgtttgaattgcgcttccgccatctttccagcctcagtcggacgggcgcggagacgcttctggaagcttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98967 - DNA, 2437 bp, Homo sapiens
catagcctagagagccggtgtaatcggagaggcggctgggtgttagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98968 - DNA, 2411 bp, Homo sapiens
actatgcaggacgaggctgggttaatcggccgaggcgctctggacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98969 - DNA, 2739 bp, Homo sapiens
gaccagctgcctgagtagctgggactacaggcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaagtaggtaaccctgcggggcgggaggcggccgagcccgaccgcgtgcgactcgcgggtccctcctcctggggccacgatggctgtaatggggccccgcatccacattctttgttttaagtgagcctgtggtggttaaagttccgtgactctgggatcttgagaggtgaagtgtttagggtttacttccaaaatgtgtttttcaacacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98970 - DNA, 2445 bp, Homo sapiens
  misc_feature (12)..(12): n is a, c, g, or t
tcactgtcatanccccgagtatgtagaggccgggtgggcccttcggacgagggcgggagagcccaatgtcagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98971 - DNA, 2474 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98972 - DNA, 2231 bp, Homo sapiens
gaccagctgcctgagtagctgggactacaggcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgacgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98973 - DNA, 2470 bp, Homo sapiens
gaccagctgcctgagtagctgggactacaggcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttggcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98974 - DNA, 2232 bp, Homo sapiens
gagaccttgaaagtgaggggagagatacaggtgactcgttgaggtctaagactataactagttgaatcctagtctctggttcttagcattcttcacttgtgcagtaaactgagtgtactaattcccacaaatgtttcttcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98975 - DNA, 2098 bp, Homo sapiens
atataatagccatctctcagtccaccgaatttctcctggccggctgtgtcccatacattgaacttaataggtcctctgttggtgtggaacactaggggatgaacctcaacacccaaggtggctacatacttcttctcaaattcaccagtcaaatgacgtttcacgaaggtcgtttttccagtaccaccatcaccaaccaatacaagtttgaactggacctgggggcactgtgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98976 - DNA, 865 bp, Homo sapiens
  misc_feature (854)..(854): n is a, c, g, or t
gaccagctgcctgagtagctgggactacaggcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcggccacgggttacatcctcattactaatctggctagnaaactcaaact

SEQ ID NO: 98977 - DNA, 784 bp, Homo sapiens
  misc_feature (26)..(26): n is a, c, g, or t
aagagagtacaacctacggctaggtncgaggctgggtgttgcttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggctccagaccactggtcccccggttaggatgattgactgtgggaattgactgggccccgtccaggctagtttaggcggggccggg

SEQ ID NO: 98978 - DNA, 575 bp, Homo sapiens
gaggatcccgaatacagagctatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcgggtcgacgcggccgcgaatttagtagtagtaggggccgc

SEQ ID NO: 98979 - DNA, 1132 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaata

SEQ ID NO: 98980 - DNA, 1283 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaataaaaaaaaaaaaaaaaaaaaaaaaaaccttgttggccggggtagagagagtaaaaaatttaacacccatagtaggcctaaaagcagccaccaattaagaaagcgttcaagctcaacacccactacctaacctatagaagaactaatgttagt

SEQ ID NO: 98981 - DNA, 1276 bp, Homo sapiens
  misc_feature (1141)..(1141): n is a, c, g, or t
  misc_feature (1144)..(1144): n is a, c, g, or t
  misc_feature (1148)..(1148): n is a, c, g, or t
  misc_feature (1155)..(1155): n is a, c, g, or t
  misc_feature (1159)..(1159): n is a, c, g, or t
  misc_feature (1164)..(1165): n is a, c, g, or t
  misc_feature (1168)..(1168): n is a, c, g, or t
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatagtgttccanttnaaanaaaaaanaccnggctnntcngggcggaaaggtaagcccgcctggcggcctctaagagagacggcctaggtttcatgggctcaacacaaatagacagaagccaactacacgccagccacttttctacca

SEQ ID NO: 98982 - DNA, 1254 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatacaaaaaaaaaacccgcaggacacaagtcgggcgcgaaaaaaggtacgaaggcccatggcaaggttcccgcacccactcttgccaaggggaaaacgcgggtcccaaagggggattatgaaagc

SEQ ID NO: 98983 - DNA, 1093 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtgctgctcagacggtaccgcct

SEQ ID NO: 98984 - DNA, 2489 bp, Homo sapiens
tacttacggctaggtacgaggactggcggtttaaattcggccgagggtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98985 - DNA, 2470 bp, Homo sapiens
  misc_feature (27)..(27): n is a, c, g, or t
ttaagcgctagtacgagccgggtgtanagcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98986 - DNA, 1070 bp, Homo sapiens
  misc_feature (890)..(890): n is a, c, g, or t
  misc_feature (897)..(897): n is a, c, g, or t
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggacngggatgnaaggaatatggtcggggagtgattaaaaaatctgtggctcattttggacaggctgatatagagggagcacattgggatgtgagaccgtgtgaaaggcaatacggaagaagaaagaggatatgttttttttccttttgtgttttttttttggaaaaaaaaaacagcaaaagaaa

SEQ ID NO: 98987 - DNA, 2450 bp, Homo sapiens
aggggtgcagaaacgatatacggctaggtcgaggctgggttgtggcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98988 - DNA, 2481 bp, Homo sapiens
  misc_feature (76)..(76): n is a, c, g, or t
  misc_feature (87)..(89): n is a, c, g, or t
ggaggaggcgcacgaatgatgtcataggcgatgaccgggttgttatttcatcacgagggcgcttctggaggaacgncgcgatggctnnncggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98989 - DNA, 2531 bp, Homo sapiens
  misc_feature (12)..(13): n is a, c, g, or t
  misc_feature (36)..(36): n is a, c, g, or t
  misc_feature (44)..(44): n is a, c, g, or t
  misc_feature (53)..(54): n is a, c, g, or t
  misc_feature (79)..(79): n is a, c, g, or t
  misc_feature (87)..(87): n is a, c, g, or t
  misc_feature (92)..(92): n is a, c, g, or t
  misc_feature (103)..(103): n is a, c, g, or t
  misc_feature (115)..(115): n is a, c, g, or t
ggcttctccganngccgtcacggtcgaggacagggncagccggnacgaaacgnnctgtcgtcggcaacgtgcatagcgncctgcagnagtgngactcgactgncgagcgaggagnacgccactcacaggttacctaggcttgcaagacctgtgctaatatggctgtggttggattggtcggtacttggagacaatgctgagccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98990 - DNA, 2551 bp, Homo sapiens
  misc_feature (184)..(184): n is a, c, g, or t
ggtggaccgggcgcggatacagcttctggatagcgaacgaccgagagtaagttagcgctaggggaagatgccccataggtccgatgtttcaagaactctcgatactttgtgctttggttgcaatgagtgtgtacgtagtgcatagacacagcggtacctccttcctgattgaagatagcaggtntccagttatttgaacattgtgttcggaatttatggcacgaaaggtatagtacttgtaagtccaactcgtatgtcggtgctatgagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98991 - DNA, 1087 bp, Homo sapiens
tacttacggctaggtacgaggactggcggtttaaattcggccgagggtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaata

SEQ ID NO: 98992 - DNA, 2184 bp, Homo sapiens
gaggatcccgaatacagagctatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98993 - DNA, 2464 bp, Homo sapiens
gaccagctgcctgagtagctgggactacaggcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98994 - DNA, 910 bp, Homo sapiens
ccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagagtggaacacattttgaccccaattaaagggtgctcacacacttgttttccgggggaggaaatgacccgggtgagcttggcccaccggctaaatctatttttttagggcgtgtccttgattccgcccaccggtttgccccctatattatttacttagcggtgtgtttttgggggg

SEQ ID NO: 98995 - DNA, 1903 bp, Homo sapiens
gatctagcaggatcctaatggctggctgcacattaggcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 98996 - DNA, 696 bp, Homo sapiens
gaccagctgcctgagtagctgggactacaggcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatcgacctatgagggatcctctagaacagcc

SEQ ID NO: 98997 - DNA, 556 bp, Homo sapiens
gggggctctgctcccttcctcggtctccccactcaggcttgccagtccctctcagtgggtgactgaaagccctgcagcgcgccggctcctgggttctggtttcgcttttcggcgctgttgagggggccggccccgttgtttgttgttgtgaacggaaaaaccgaggtgtcatcgtccctggaatttttcttcgaccaatgtttgatcttgactgagaggttaccccttaccttctgtccatctgcagcctttgtttggatgaaagatccatagtgtgtggtttcccagacctttacttatatttctcgtatacaaaacgctcttcatttgaatatttacagggttttacgttgagctcttggacgatgagattttcctgggtgttttgcactcaagtaccgttggagtttacattctcatagaatcagtattaggcctggaaaattgagccagagggtgaaattctggcaggagcatagacttaaattgaaggtgaattttaccgtaacgatctctaggccttttgcttaataactatgtggatgtagagaatttt

SEQ ID NO: 98998 - DNA, 204 bp, Homo sapiens
ggagctgcagatgtttcactgggaataacaaacttcaaaattctgctttactgggttgtagcaattcatggctacagggagaaagaaacgctgttttaagctgagtaaaccaaagcagtgggaggaattcaaatccaagtaccccagtgttaggcactctggggacgaggtgtagggagagggtggtacagagagaaaatttct

SEQ ID NO: 98999 - DNA, 698 bp, Homo sapiens
ggctgttagtagctttgcctggtgtttcttgcttggattggcgtttcctccctcgcattcctttgctggacttgaccttttctctgctgggtttggcattcccttgactgggctgggtgtttccttgggagggggggcttggcctttcctggggtgggcgtggggtccccctggtgggcgtgggctttccccgggtgggtgtgggttttccctgggtggggtgggctgggctcccttgctgggcttggcaagttttggctgggattgacctttctcttcaaacagattggaaacccagggtttcctgctagttggtgaaactggttggtagacgcgatctgttcgctactaccggcctcccctggctgttaaaagcagatggtggctgaggtttgttcaatgcccgctgcctctgctgtgaagaagccatttgatctcagaagcaagatgggcaagtggtgccaccaccgcttcccctgctgcagggggagcggcaagagcaacatgggcacttctggagaccacgacgactcctttatgaagacgctcaggagcaagatgggcaagtgttgccatcactgcttcccctgctgcagggggagcggcacgagcaatgtgggcacttctggagaccatgacaactcctttatgaagacactcaggagcaagatgggcaagtggtgctgtcactgcttccc

SEQ ID NO: 99000 - DNA, 268 bp, Homo sapiens
tgtcatgtacctgtacttccagtgggagctgaggtgggaagatctcttgagcctgggaggtggaggttgcagtgagcccggattgcgccttgcaccactacagggaaaaaaaaatgaatgagaagcctgagctttctggagcaaatcttactgtttgggagtgtaagaggctagtctgacttcttgaccctccagattaagatagatgctgttcctctgggcttcctcagcaccccaggtttcccatcatggctcttaccactttgtg

SEQ ID NO: 99001 - DNA, 324 bp, Homo sapiens
gagggaagccaggcactgggacagcaaccggaaggtgtttttctatggccacaacttccaggagacaatgaggtcacaggatgggtgaacccatgatccgtggcaccaccaagctcttggttaccacggcacaatgccttggcagcctaagcccttcctgccctactactaacctgctggcagttccgaatccacctctgcacgctctcagattctgtccttacctgtccaccccgttcccatcactccaagaccaggccctttgttcctcctgcagtggcctcctggttagccaccccttctggtttttccttgccctgactc

SEQ ID NO: 99002 - DNA, 452 bp, Homo sapiens
ctagcactttggaggccaaggcgggaggattgcttaagccccaggaggtcaaggctgtagtgagctgcaattgtgccattgcactccagcctgagtgacagagcaagaccctatttccaaaaacaaaacaaaacctacgttctttataactgtatggttgtcctttatcctgttagaacaaattctgtttaacagatttactgttgttgggaatttagctgttttccattttttgctatcataattagtgaagtaacattcatcattgtaaatatatttttcaatatctctgtaactgtttccttaagataaatttccagaagtagtattgctggaacaaagactttgaagaatttgtttgtccaaaattgccttttaggcttggcatggtggctcatgcctgtaatcccagctacttgggaggctgagacaggaggactgcttgaagttgg

SEQ ID NO: 99003 - DNA, 336 bp, Homo sapiens
ggttcgggaagctggccaggaaccttcctcggttagaggacaggagagacacagcaccataaagggtcagggaggaatgacagaccagcactagttaacttcgaaaacaccttctgccaccgaggcaagagggaatcccctgcctctccaaggcctggcgttctcctccatgagatgctgacgggataaaaggcagagcccatgtgtgcagagaccccacgacacagaaacacatcagctcccttggggcagcagccgtgcccagggagaggctgagagagtcagagagggatggttgctcctaactctgagtccacggagagataggaggcccag

SEQ ID NO: 99004 - DNA, 595 bp, Homo sapiens
aactgccagtgcccagcagtcgtagttgagtcctgctgatgaaacagaaaacctgcaacctgccctgtttgcaggcagaacagacagttaaatatatcagccaaggaacagcaggggctggtagctgaagtttggacagtcgagcccgtaaatgatttattccactctgttaagcttcctgaatcacagagaagttgtcagaaagattttagcctccgctataggaagtcctgcccaccttctccagatctctgttctcatagtccatcctctggttccaggtggaagaattctaaaatcacacaagaaaatgtaagatatcttcctcgaatatcaacagagaagaacagcagccacgtggataaggcagagtttgggaaatcctggattcccttatcataaagcatcttacagtaacctcagaaatgcagaagttacttgtaatggtgctgtagacactgtacgagaaagtttcacctttatgatctaatttaattctcacaaaaaccctgttaggtagggtgttattatttaaatttaaatcagaggaaaatgtaacaggaattcattctgcaacttacagtcaaagagataa

SEQ ID NO: 99005 - DNA, 753 bp, Homo sapiens
acccggcagttgggggatgccgacgcctgggccttgaggatgctgcggaagctcaccatcgagcagatcaacgactggttcaccatcggcaagacggtgaccaatgtggagctgctgggcgcgccgcccgccttcccggcaggggcggccagggaggaggtgcagcgccaggacgtggcccccggcgctggtcccgcggcccaggctccggctctggcccaagctccggcccggccggccgctgcgttcgaaaggtcactcagccaaaggagctcagaagtagagtatattaacaaatacagacagctcgaagcacaagagcttgatgtgtgtcgcagtgtccaaccaaccagtgggccaggtccaaggccatctttggctaaattaagcagtgtgacatgcatcccagggacaacttataaatatcctgatttgcctataagtcgatacaaggaagaggttgtgtctttgatagaaagtaattccgtggtgattatccatggggccacgggaagcggtaaaagcactcagctcccgcagtatatcttggaccactacgttcagcgctccgcctactgcagcattgtggtcacccagccccggaagataggggcaagcagcatcgccaggtggatcagtaaagagcgtgcctggaccctgggaggtgtggtgggctaccaggtagggctagagaaaatagcaacagaggacaccaggctaatttatatgacaactggagtcctgcttcagaaa

SEQ ID NO: 99006 - DNA, 585 bp, Homo sapiens
aagtcccttcccttctctgagcctcagtttctgcaactgcagtgaggggtatggactagaggagaagtctgtgaccttctgggggttatagaaccctttgagaatctaatgatggctattagcagattctctccccagacacacaaattcagagtggttgtgactggcccccatcaaaagccaagttaagaacatggaaattctctaggggcccctctggctttgacaagccatggctctcacagtctagacaggaccaaagccacaaacacaacatctgagagccctgggatctcaccatttcagcttcccccgtggccctgaaataaatctttaaactcttggacctgctggcttcaggtggatttgtggacatgcctagctgtctggagaagccacaggagaaactgagcccttccttcccatccctcagcctcctcctccttctcctccatcaggaatctgccaggtcagcctagacctctccctggggcagttccgggagctgcttctgatctggaatgaaggcaggacccagtgccaggctcaagtgccagcctgtacccccagatccctcctggggac

SEQ ID NO: 99007 - DNA, 525 bp, Homo sapiens
gataggattaggagaaatacctaacgtagatgacaggatgatgggtgcagcaagccaccatggcacgtgtgtacctatgtaacaaacctgcatgttctgcacatgtatcccagaacttaaagtataaaaaaaaagatttatggatatgcaaagggccatcagaagccaacatacacttgaaaagaacaaggtgaaagataattttccaagaacatcaacttatctcagcacaacaattaaattgacatttgatttatgctaggcatatagaacactgatgcagaatgctgagtcctgaaacacatcatacattaatggactcttgatatgtcatatatgtttttaagtcactggaaagcagtgggaaaagtatgatcctatcagttgatgagcagggcacaattggatattgataaggtaaaataaaattacaaccctatctcctatcatatacaatgcccatgtgtatttgatgcctaagtgtggaaaataaagtgacaaaacttttagaggataataaaacag

SEQ ID NO: 99008 - DNA, 494 bp, Homo sapiens
tcgttgggagcctgcggagattctgcccagtacatacataccttgcgttttctcggagcctgacaggtgctgccttgaagcggaaagacttcacctcacagggtggccagctgtcctttctcttcctctccctgtcttgtgtgctcatgataatggatagatagacatctccatggtagaaataatgcagccctttctgcagtccatggttccacagcatatggtcagtagacttagatgagtgctacataaagtgtaattagttctgcaccacggtgtcttaccttctgaaaaggaaactctggtattgacttagaaatgccagttttatccttccgaccagaacgcaagtcctgaatgaggccagaggccaatgaaaggtcctttcttctctcttttcaaatctgctgtattaaacagtgacttttcctagtcattcagtattcattcattcatccatttattcaagtttttgagtaccttctttgtggatg

SEQ ID NO: 99009 - DNA, 455 bp, Homo sapiens
aaaaacaaaatcagtctatccctgtgtggtaaagaattaactttacccaaagacaggtctggcttttgcctaggctcttaggaggtgctctctaagctgttggaatgtggtgtctgaaaagaggctctttccttacccaggagccttggcccactctggatagggtggggtctctgggtcatgtagtatcagttttgcctccagaagggctggagactgaggtcagctacctgggcagccaaccacatctttgtgaccaagcctcaataagaactctggacaccaaggcacaggtgggcatctctggttgatggtgcgccacgcatgttatcacacattactgaggggaaggttagcgctatctgtgactcccaagggagaagaccactggaagcttcgtgagtagaacttttctggactttccccatgcatctcttcccttggctgatttaact

SEQ ID NO: 99010 - DNA, 447 bp, Homo sapiens
attctatgaggtctgcataatcctaatctcaaaaccatacaaagacatttaatgaaaactacagacttacatctgtcatgcacatagatgcaagattccttgacagtatcttagcaaatccaatccaacaatgtataaaagttatacactgcagccacgtggcatttgtgtaggtacgcaagactggttcaacattcaaaaatcaatgtgtaacttaccatatttgaggtgatggatatgttaattgcactgatttgatcatttcacaatgtatagatgtatcagaataccactttgtacccaatacatatatacaattactatttttcaattaaaaagtttaggccgggcgtggtggctcatgcctgtaatcccagcactttgggaggccgaggtgggtggatcacgaggtcgggggttccagaccatcctggccaacatggtgaa

SEQ ID NO: 99011 - DNA, 498 bp, Homo sapiens
atggcatctctttctgttgctcaggctggagtgcagtaacgtgatcttggctgactgcagccttgacctcctgggctcaagcaatcctcctgcctatacctcccaaatagatgataccacaggtgaagaaggacgtgtttgcttccctttctgccatgaatgtttcctgaggcctctccagccctgtggaaattcctggagaaacaagctgctgtgctgtgaactgcttatggtggacactgtgtgtcaggaatgtaggctgtctccagacaataaggaccacttctgaccaacagccaacaaaacactgaatttttttttagcaatatgaatgaatgtggaagtggattctccttctgtcaagcccatagatgagaatgcagcctgcctgacaaatttactacagcctgaagtgatgctaaagcaagaactaagctaatccatacccaactcttgacctgaagtaactgtgagacaataaatatgtgttgttttaag

SEQ ID NO: 99012 - DNA, 578 bp, Homo sapiens
tgctttgtaagaccacctcatgagtagagctgtgttcttccatcagtcaggttgcttctctgtttgtgatgtttgcagccattgatgatcactgcctagatccattaattcattaaggtctgcaaaaggaccctctcttctccactctgtctcccaggtaggaacctctgaagctgaggacgtattcttgctggcttcattattgtcatcattcctcttcgtgacctattacacatttctgaagagaaactcctctcaccagctcctttgtttcctaagatggctgggatcctgatacctacatgcatgagaagccacaccagaatgccagccgacatttgcatgcagagacgttgcctgtggagctgtctccagaagaggatgcagctgcaggtacttgaggaccacactccccctcccaagcctaatgttccctacatggcagcgcactgagcattggcaatgcaaaaaccacttctcaattactcataattgagttgcaaaaagagattattctttgctgaaacttgacttctcatcctggaagcaggtttttctcatttgggatgggagggggg

SEQ ID NO: 99013 - DNA, 1188 bp, Homo sapiens
gcaaatttttgttgggaagtggacattttgtgtgttgtaatatggtaactctgaaagtcagattccactgcctccctagggattactgttgttacttacgaaagctgcatttgtttagtgacttttccaaactgtctttgcaaagagtgtatatctggttgcatgcggtcactgaagtctctgttcttttatctctgtggtctttcaatgacttgacagagagttccttaaatgcttagatccaataagaaaagaaaacagaaagaaaaaaagagtgttctctccctttaagttcacttgtctagtgccactaggtaggcaacttcagtcagggggtgtgcatgtgtgaaacagtggccagcgctctggcagctcctcagcaatcaaaagtagtgaacgaaacacataacttcaatttttggaggacaaagcccctatttcctgccctagcaccagcaagctgcagcagaaactgccatcccaacagttggttaccacagggatgggagctagagaatgataagatgctattccaaatgccaaaattcactaaaatttaccaacttttttcttcatcaagcactcttctggacactgcaagtgtttcattagaccccagagtcctaaaatatcacctcaagcagttcttgccatctcaatagttactttggtgaagatactaactcctgaagttcctactctgtcatcttgacctatgtccttaattttcagcaccgatttagttgatccaaccctccttctcagtgtatgcgcgcacacacactcatccaatctgttctctacacagaaagaaccctttgtaagtgccagtgcctatgtttttttcacttaaaagataatttcattcttaacatggaaaaagcggagtaaaaaaaaaaaaattcacagctgggcgcggtggctcacgcctataatcccagccctttgggaggccaaggcaggtggatcacgaggtcaggagtttgaaaccagcttggccaacagggtgaaacctcatctctgctaaagatacaaaaaattagctgggcatggtggtgggcacctgtaatcccagccactcgggaggctgaggcaggagaatcgcttgaaccctggaggcggaggttgcagtgagcgtaaattgtgccaatgcactccagcctgggtgacagggtgagactccgtctc

SEQ ID NO: 99014 - DNA, 864 bp, Homo sapiens
caaaataccagcaaaccagatttaacagcatattaaaaggattatacaccatgaccaataagcacatgaaaagatactcaatgttgctaattaaggaaatgcaagtcaaaactccaagatgctacctcacacccattaggatggctgctatcaagaacaacagttggttaccacagggatgggagctagagaatgataagatgctattccaaatgccaaaattcactaaaatttaccaacttttttcttcatcaagcactcttctggacactgcaagtgtttcattagaccccagagtcctaaaatatcacctcaagcagttcttgccatctcaatagttactttggtgaagatactaactcctgaagttcctactctgtcatcttgacctatgtccttaattttcagcaccgatttagttgatccaaccctccttctcagtgtatgcgcgcacacacactcatccaatctgttctctacacagaaagaaccctttgtaagtgccagtgcctatgtttttttcacttaaaagataatttcattcttaacatggaaaaagcggagtaaaaaaaaaaaaattcacagctgggcgcggtggctcacgcctataatcccagccctttgggaggccaaggcaggtggatcacgaggtcaggagtttgaaaccagcttggccaacagggtgaaacctcatctctgctaaagatacaaaaaattagctgggcatggtggtgggcacctgtaatcccagccactcgggaggctgaggcaggagaatcgcttgaaccctggaggcggaggttgcagtgagcgtaaattgtgccaatgcactccagcctgggtgacagggtgagactccgtctc

SEQ ID NO: 99015 - DNA, 599 bp, Homo sapiens
acgcgccggtttgttaccctgccgggtccggcggccgcccgggtccggcgaggcggggcggcccggggtcccgagggccgggtgcctccttacctgcagccgggcggccgggccggggatggcgggcgccggccgagggcgctgcttggctgcggcggggagaccgggcctgggttgcggcgggcggcggcctggccgggggcgctgacagacgcgcggagggcgggggaggccgggaggtgtcacccggcccagcggggtggaagtgcctggaaagtttgttttcggcttggcgcagcctggagccgagcctccagggttacctttcggttctgtctgtagaggaaccgccctgggcttccacctggaacggggtccttggcgcctccgcctgcgagagaagcagaaggtgcaagttcttgctgaaagcacctgatgctcctgggcccccttttccagattcttgatgacagtggtcgggaaaactcgcctttcacggcccggccaaggggcatttgggtgcttttgctgcccgtggctgtgctcagcgttgtgggaagcccctgggaggccgaatgtgcaggatcaccgaggggaaa

SEQ ID NO: 99016 - DNA, 341 bp, Homo sapiens
ggaggaacagaggaaaaattagtgagtgggagaaacaaagaaagaaagagagagagcaaatggtaaacccaataaagttaataaatgttttacatgtaagtggattaaacacttcaattaaaagacagatttctacactggatcaaataacaaaacctaagtatatgctgtgcaatatagatgtgtattaaatataatgctgggtataggttgaaagtaaaagtgtggaaaattatataccatgtgaacagcaagtataagaaagctggagttgacatattaatgtcaaataaacgacactttactgcaaggagtttccgcaaagataaaatgagatataa

SEQ ID NO: 99017 - DNA, 453 bp, Homo sapiens
  misc_feature (448)..(448): n is a, c, g, or t
  misc_feature (451)..(451): n is a, c, g, or t
tttatagataagtctgctcattttagcattgtttataatagctaaaaaatttgaaaaatttaagtgtctatcatagaagattagttaaattatcttacaggcatgtaatggagaagactgcagtcttttttttttttttagtgaggcaaatctatttttacttagatggcaagatgtccacggtcatagtggtaagtatagagaggaggaggagttagacaatagtgtatgttatctgaatttatttatagaactatgtattttaacatatatgcttgacattctgcaaggatatgaactaaacagttaaaagtagttatttcttaggcaggattatggggtgaccctttcactttctactttagatacttcagtatgaactttttctacaaccatatattgcttttataatcaggaaactcaataaagagatttctattaacaaaanaanaa

SEQ ID NO: 99018 - DNA, 1010 bp, Homo sapiens
aaaatcagtcccttaaaataaagttcacgctaatagcaggactctctgagatcccataccctgaccatttgaatgacttgtctttttctccagtgtttgggggctttcatatatgcttttccttttacccagattcctcttgttccacaaatataacctaaatacataggtgttaagccagtgtttaccgtttgtcttcctgttatttggagatttgaaaaatcttacttttaattttatttttaaatattttattgtgtatatttcaggtatacaatatgttgttatgggatacatatagatagtaaaaaggttactgtagtgaaggaaatgaacatatccatcatctcacataattacccaatttttaaaaagtttaccaagtccatccttctgcagaaattacctatttttttgtttttgtgacaagaacagctaaaatttacatttaacatgaatcccatacacagtacaagtttattaccttgaattaattcattaaaatattcttaattataagtgacatatgagtagatatgtaaaaatagttatgctgtctgtctcaactctacttctctttgcatagggaatcactgttaacaatttggtatgtatctaccccatctgttgtaccttgtgtaccaggggttttttaactttattttattatgtagatatatgtcctctgtggaaaacatcagtagaaataagctaagaaaacatctcccagttgggcttggtggctcacgcttgtaatcccagcactctgggaggttgaggtgggtggatcgcttgagctcaggagtttgagaccagcctgggcaatgtggtgaaaccctgtctctacaaaatatagaaaaatcagccaggtgtggtggcttgcgcctgtagtcccaactacttgaggggctgaggcagaggatcgcttgagccagggagttcaaggctgcagtgaaccaagattgcaccactgcattccagtatgggctacagaggaagactttgtctca

SEQ ID NO: 99019 - DNA, 725 bp, Homo sapiens
cactagtaacaaaagaaaaaggtaaatttttagaaaatgacataggaattctaatggcatacacatcaaagtaggtgatgaagatatttatatttcttcttgatgtcaaatcactgtttatcctacagaagtcaatgttatggcctgtgtagtatctggtcttttctggttgcattgttttgcttatggataaaattttgaaagggcataaaacagacaaacaaatgtctattggacttgggtaggacggggctttaatctgtgacgacttgttctgttttatcacttctcatattttggcaaaccaggctttgacagtaggctgactcttcttggttataatgtttagttctgccaaaatatacagctatttaaaagtaaaatatcaagttccttttgcaccataattctttgcttaaaataccttgtagtattttaattgggtttccagattgttgtgttctagtaatggacaccatatgtttaaagaagcagtatgttatagtgtagtggttaagagaacaaatagtgagtggttaagacatacgagctgggagttagatagcctgagttcagatcccaattctgccgtttactattatgtgatcacgggcatgtcagtttctttataaacagggacaaggatacttatcttatagggtcttgtaaggatcaaatgagttaatacatataaaatacttagagaaagtatggtccttaataag

SEQ ID NO: 99020 - DNA, 318 bp, Homo sapiens
caagggtttaatgaagagctatagaagcttcactgaacctcggagacccagaaaaactaagggaattttcggaatttactcatagtatcttctcactctcctctccagattttcagaacatatggtgggcatacagaagtcagtaaaaagcatcaaggcgtataccacctgcctctaaaatcatccagttttcctatatgccctgttgcaactgcttattaaaacaaggttgctaaataattcattgttgcttttgttagataataataacttattttttaggcatattttaacttcagcaataaatcaggaaattag

SEQ ID NO: 99021 - DNA, 573 bp, Homo sapiens
tcgctcgctcgctctctcctgctccaccatgataagatgtgcttgcttccccttcactttccgacttgatcgaccttcaagtacatgctccattgaactctctgaattcagctggctaaaaaagaagaaagagaagatggagaaggcacaaccattctaaactgccttgacatggaggtgacaccagttttattgtaggaataagtgacatgattgtatctaattgcaagggcctgggaagcacaactaaccatgcaccaaagaagacaagaacacaggcagcttgggtcatgtgctacagctttcctgtgatcaccttgcctctgaaatatctgaaaatggctttctcttcattcatttctacatcttcattcattctcccaggtcttgcaatggttgtgcacataggtagaagagacttgccttgtctcagatgagattttggacgtttgaattaacactggaatgagttaagactttcggggactgtcaggaaggcatgattgtattttgcaatgtgagaagaatatgtaatttgagagggactagggacagaatgatatagtttggatc

SEQ ID NO: 99022 - DNA, 469 bp, Homo sapiens
cagctgttgttattcaaagactttgtttttggaacaaatactttggcaaccaatacggagggtgtactggagcggggagttctgtgaggtgccttgtcttaaagtgggttcttcagaagcaaacaagaagagaagggctggtggagtagaaaagtaatttgctttgtccatgttaaaagccaaaagggagccaggtgtggtggctcatgcctgaaatctcagcactttgggaggccgaggtgggcgaatcacttgaggtcaggagttcgagactagcctggccaacatggcaaaactccatctctactaaaaatacaaaaattagccgggcatggcggtgcatgcctgtagtcccaggaggctgagacaggagaatttctttaacccgggaggcagaggttgcaatgagccaagatcacactactgcactccagcctgggtgacagagcgagactctgtctcaaaaaaa

SEQ ID NO: 99023 - DNA, 368 bp, Homo sapiens
acagacaagtactacgttttccaatattttcagtgcagtctgagtcagtgactggaaatggcttctgattggaaaaaaggcttcggctttcttgttccctttggcatagtagtataagtggggacaagctaccgtcttgcaatatagaaacacattaacggtgtcaagaataagggggaaaagtacaaatatcttacttttcattggtactataaaaatacggagaattatttctaactgtatttatagaagacacaggtaaactggaatattaataaacaaaataaaactaaactaaactaaaaaaaaaaaaaactttgggccaggcacggtggctcacgcctgtaatcccagcactttgggaggcc

SEQ ID NO: 99024 - DNA, 766 bp, Homo sapiens
cagaccctgcacttaatggatcagctgtccccacccagatcaataaactggctcatctgatcttctggcccccaccaggaacagactgagcgcaagaagacagctcggactccctatgatttgatttctgaccaatcagcactcctggctcactggcttctccccacccaccaagttctccttaaaaactctgctccccaaatgctcagggagactgatttgagtaataatagaacgccggtcccgcacagccagctttgcgtgaattaccctttctcaattgcaattcccctgtcttgataaatcggctctgtctagcctaggcagcaggcaagatgaaccccttgggccattacatttatgacctgtatcttgtgctgacctgctatctcatcctgtgacagagaatgcctaaccatctgggaatgcagcctagtgggtctcagcctcattttaaccagcccctattcaagatggagttgctctgtttcaaacacctctgacacagctagacagactcttgtcacaaaccattgtctgcactgcaggcccaacagactttgtcccaggcctctgtatactcttcaagcccactgaatcccccttaaaaatcatatactaaccccctaaccttatccacactttgccatctccctttcccctaagaagaagggtatataagcatctgtaccccatggtgcagtggagcaatcagtctgtgatttccccccatgcatgttaataaacgtgcatgccatttctccta

SEQ ID NO: 99025 - DNA, 293 bp, Homo sapiens
aaagtcgcagagatagcggagaacaagaaccagatctcacagtcatggtgccaaaagactgttaccctagcatgactgcttcagcgaagagataagagcttctttgactttttccactggaatttttcatgccagaagaaattgaacatgtgagcctggtgtctggaagagtagcctggatttatggtatcagatgcacatttttaacaccttcagttttctctttaaaatatctcttcaatcccttacttttctctatttgtttcaacattaaaatatgttatttttcttca

SEQ ID NO: 99026 - DNA, 1414 bp, Homo sapiens
tgaactggactacagtgtgaatgctggcgcttatcgtgttgaccctgtggtcgccatgccacggttgccacatctcgaggacatggctccctttttgactacctatcccgcctcagtttggatttggggacctggaactttagcgtgggtaactccattttgattctcagccggccctgttggggcctagtgcggaaacttagtccaaaacaatggccttctataatttttattaaacaaatcctatgtaatcatgtatgattctaaagcccttaatggagtataaaatatgacttaaaaattacttgcaataattcagaaaagttgagaagaaaagaacattagctccaaattatttggcagaattaaaaagagggttacaagtgacttttggaaagtacacattggggtgtacaaataaagtactttctctgaatttcattagctacattaaaaaaagaaaagatcaaatgcaatagatagcactgtaatagattttgctacattaaaaaaaatccatttgaatacacagtgaactaaaacaccagagtggctaaaaagtcccttcatgcatatttacttagcagagagctcttgagaaagacccaaccaataaaccccaaccaaagcaaatccagctacttctctagctgagagggtggaatgactccaaaatattgtttcaagctcaaaaagcctaaaacaactccacataaaaaaacaaaaatctatctaattggacatttacctttttggaaataaaaggcccagtgggaaaaaaaaaaaaaaaagaaagaaaggaaggaaggaaggaaggaaggaaggaaggaaggaaggaaagaaagaaagaaagaaacccttttcttagatccttagaagactcgactggagcccaaaataaatcccctgaattggccaagtattaaaggactctattctccttccctgcctttagtgtgctggagccctaacaagggcaaagaactgccagtggtcaagagctcaaacacccggaacaacccagcgacattcacagacaccagcaactacagccctgacccgagttggccctcagttcaactcttctgacggtcctcctgattttgcagataaagatgtggattcaggccaggccctgtggctcatacctgtaatcccagcactttgggaggctgaggtggccagatcacgagatcaagagatcgagaccatcctggccaacatggcgaaaccccatctctactaaaaatacaaaaattagctggacatgatggtgtgtgcctgtagtcccagctactcgggaggctgaggtaggagaatcacttgaacccaggaggcggaggttgcagtgagctgagatcctgccactgcactccagcctggtgacagaatgagactctgtctcaaaaaaaaa

SEQ ID NO: 99027 - DNA, 281 bp, Homo sapiens
tgctgggattacaggtatgagccaccacacccagccacagactgcctccttgactgtgtattttcgtttgtgagacagtgaaagtggtggtgaatgaggcacaggaactgtgccccgatgatgacaatgatggtaatgacagcggctaccattgagcacctcctatgtgttaggcacagtactggggactttacatttgttatctcatttaatcttcataacaaccccggtgtgttattttattattgtcatatttgcagaagctaaggtctagggaacta

SEQ ID NO: 99028 - DNA, 282 bp, Homo sapiens
gctcttcatatacatttatgtaattaaacatgcagttgtgacttggttgtctctcacttatgtaaaatacatcaaatcctcataagttattgttcttctgtaggttttgaaaagctctatgaaaaacaaaacaaaaaattagccgggcgtgttggcaggcacttgtaattccagctactcgggagggtgaggcaggagaattgcttgaaccccggggggcggaggttgcagtcagccgagattgtgctattgcactccagcctgggcagcagtcgacgcggc

SEQ ID NO: 99029 - DNA, 105 bp, Homo sapiens
aaaatcatgtttataatagacccgtgcatgcagcctttcctccttattccccttcatgcccccctttccccttcattccccccgccaccccggtttttttttttt

SEQ ID NO: 99030 - DNA, 751 bp, Homo sapiens
ccatgttagtcagaatggtctctatctcctgaccttgtgatctgcctgcctcggcctcccaaagtgctaggattacaggcgtgaaccaccgcgcccggcctgtgttgctttaagccaccttatttgttaggacagcaacaggaaactaatacaaggttcaatccctcactgacgatgttctggacgacaggacccctgcctggtgcctcatggtggacccacagaatcatcttcatacgcacgggggagaaacatcactaatgtccaccagcaccggcatcctcagccgcgaggacaaatcccttaccctcccagcaggtttcatctgcgtaacggaaatagtggtgaatttatcaggggctgttaatagatgacaggcaagggtgaagtcatcgcaaaagttcccagacgatatggacagctgctccccaataattactgctccacgcagtccacagcggggctgttattgaccccgacaggatgacgggacactaaggtgtgcagtacacgtcctcacagggagatttaaaaaaccggcagtgacccctgccccaagaaggccaagaactgctactctaaggtgtgcagcgcggagcttccccaccatggcaatttcagccatggcagctccttcccctaatcaccagggctcagaatctttatttcactcctttacccaatgcaattggcatcaaacgcgggctgggctgcgcccaaatggtcccagctccccggctctctcctctct

SEQ ID NO: 99031 - DNA, 873 bp, Homo sapiens
gcaccaacaatgaagttcaacttacggctctgctgcttgcttccttgcttgtctgcttgcttgattgattgacagggttttgctctgttgcccaggttggagtgcagtggcatgatcatagctcactgaaacctcaaactcctgggctcaagaggtcctcctgctttaatctcatgagttgctgtgattacaggtgcatgccactgcacccggcctggctttaccattgtaaacttcgagaacttacaagttatctgtcatgcctcatttctctcacctgcaaaaatggaataattagtgctactcatagtaatagctaatatgtattaggtgtttgctatatataccagtcacagttctaagaattttatttgtattaactcacaatcctcacatcaaccctatgtattgctagtattatgcccatttacaggtgagacaacagtgacagaaacagtaatttgctaaagattggtggagtcaggattagaacttagtctgactctagagtttatgctcataatctccaccttcatagttttttgttttttttaatttagcatataatcaagaaatagagtagttttgaagattaaataaaatctatataaaatggctgtgacaagcatttacggtattaagtactacagttagcttcgagtttacaaagcattttgcacacattttctttgattgtcataggaataaccaaatatgcttgtgaccatcactgtccggcaggaaacaggcacacatttggtcactttcccagtcatgcagcatgtgtgcagacagtgccctggtgttgctcctccatatctagatcatgtggaatttgaagcatcacattttgagaaaatttagtagacataa

SEQ ID NO: 99032 - DNA, 296 bp, Homo sapiens
gtctattttggtatgtatgactaagtatttgcttgcagcttcttctctttttcctttcccattgtcaggttttaggaaacaatatttcccttctgtccaatctctgctattccttctgtaggcccttccctccccaacttccctgcattttttttattctttgaaattagcaatcatggccacaatcagggttttagcaaaataaattcttgtcaaatcagataatgggttaaattcaaggaggaggtagcttcaactgatcgaggtaatagagaaaatcagcatttcttccagcc

SEQ ID NO: 99033 - DNA, 617 bp, Homo sapiens
gaatgtgtccagctgtatgtcatttggttataagcctgtgtggcaggccaagtgtgagctacagctgttttggcacgcaggggaggcctgtgctcataaacagcctcggagtgggtgtgcctgcctgaaggtccgcctgtaccacccaggcccaggctgggccaggacccagctaatctcccccagccagaaggtgctcccaggcttcaactcgggacaccaagcctgccccagtctcgcatctcagcctgcactgacgccccagaggctggagaaccctgttccgtgactcatcatttccttcccccaacttccaggaagtccccaacgtggagacactgaatgagcaagccctaaaggcaagcgcaagggggcctctgccccccgccctcctcaaagtgggggaggccattcttgggggcgcggggcagaggccaggagaaggaaaagaatctgctcccctttctaactggtcctcttctgggctgcctgctagggggtggcccagacagaggaggaaacgggagggaaaggcaggggtggcagggctgatctaaaagataaaggggaagcggccagaccccagctgaaatgggcgggaagcggaggccaaaaac

SEQ ID NO: 99034 - DNA, 765 bp, Homo sapiens
atgcatggatgttagattttgtcagcttttttctgtatgtattaataggatcatatggttgctatttagtctgttaatatgatgaattacattaattgatttataaatgatagaacagactttcattcttgggatgaatcccacttgttcttgatatattattattttttatattgttggattaaatttgctaatactttgttaagaatttttgcacctatgttcatgagaggtatttgtcattttcttgtaatgttttgtctggacttggtattacggtaatgctggcctcataaaataagttgggaattgtttcattcttttccactttctgggaaaggttataggcagttggtatcattttatatctttcatttctaatatatgcatataatgccataattttccccctcagcactgctttcactgcattccacaaattttgataagatgtattttaattttcatttagttcaaaatatgttttaatttctagacttattctttgacctgtgagttatttagaactgtattgtttaatttccaaatatctgggaacttttcagctatctttctgttactgatttctagcttaattttttttttgtctgagaatgcattttgtatgatttctattcttttaaatgtgttgagtgtattttatcatctaaaatgtgatatctttttttttttttcagatggagtttcgctgttgttgcccaggctggagtgcaatggcacaatctcagctcactgcaacctcca

SEQ ID NO: 99035 - DNA, 406 bp, Homo sapiens
tgaaataaaactgaagtttaggaaaacgtttcttttatgctatatttaaccacatatgggttatgatggcaaatacttgctacatcttagaacaaagatagatcaaatgccttttttaaaaaacttcaatttttttctgataaatcagaaggagtgctctcactgcaaacacccgggaccagtttttttttttaaaaaaaaaaaaaaaccttccaggattcctcagttctcccaggggccggctctgcaacctttgttattcaaatcagaggctttgaagctggtgaccttgtgggttttcctgtcttgttaacccagttgttatctgtccaaggctccagtgtcggccgctttgagcaccagcccagtgactctcacgtcactcacataaacttcatgaaacacc

SEQ ID NO: 99036 - DNA, 482 bp, Homo sapiens
acttttgcctcatgttagatttttttttctgctaaacattgctgttatcttagtgtttgttttttgttgactggctgtttggcctgagaatttagttctgaattccttttttttttttttttttaaggcaacagaataaacaagcaactgtgtgtcccttggcgcggtagccaatttaaggtgattcatacccagttacttaatagtaaagtctcattcctaaaggatataaactctatttcttgcaaggatgcttaaagagctgagcaaatcttaaagcattattatcacattttagactaaataaagatattttcgttcattctaattttcgtcattcccaaacacactgtggccttctgtggcatgagtagtttaatcaagtgtttagaatttcttggcctcaaccagattagaggaatttaactcagctgttgttgagaagaagtaattcttcagtcactactgaggttttgtaagtg

SEQ ID NO: 99037 - DNA, 137 bp, Homo sapiens
ccttttttatgccaccgacatattgtatatgagttctgtggaatgtctcacattctgaatttgtctgtcggctgcctcctggatcatttacattatttctccattgtctatatttcctgtaaactgcaagttgctct

SEQ ID NO: 99038 - DNA, 770 bp, Homo sapiens
gcagcctatactcagtgttaagaattgctgcttacttttgatgtttggacaagagctggcactgctagagatgttctgccttttgaggcacagctcatgccatccatgtgagcacagagtctcatcagcattcacatcttacctgctactggtctcacactgtggaaatgggtaatagaaacagaaacatcagtgacatttggctcttttattcagaggaatcaaaagtgacaaagagaagccagggtcagcagtaggcagtaggtccacccattgggatagcatagctattggggaaattgtcagcacagaggcaaaaccatggtattccgtgactgcagcaggaggtctgcagttgtgactttagccaagaagcattgggaatccaagatgagttgacaaggaatctatcctgatgtttgtctttgggacaaacatcaggaaacacaggaagtagttgctgtgatgaagtccaagaaaacaggcagagctaaggagctccaaagaggggaagacaggcaggaattgataggtgtggggacccccacaggcagaaatggcaccttcaagactcccagcagcagagtcttagagggaatggtggagcagcgttgggttgcctagcagctgaacagagtccatagcatgacaaaatggacaagacaggacctaagcagagaaagccatatactcgcagatgactaccttgtcacagaagcattatgagacacagcctcatccaggcaggtagatggtgacatcatccttaa

SEQ ID NO: 99039 - DNA, 743 bp, Homo sapiens
actcttatcacagtgcccttcaccagtatgggttgaaagaatgaatggtacaggtaaccattgctgagaggcacaagaaaagaagggaaagctcagttgaggctgagcttaaccagggatggctgcttcttgttgaacttgtacgaccttttagtggtctgaggtaggtaagacttcttagtccagccacaatctgcaagttacttttgccagatatccttgaactagattggtaaatgagaatcacagagaaaggttggtcaccagcagaacacagttaatccctgcctccacctgattgtgccgttcaaaaattattttctctacctgggatattcccccctgatctttgtgtggttagcaccttcttcactcatctcacatattacttcctcagagcagtttcctttcccagctactccatctgaaatcacacccctccatagcacagcacccagttgtatatatattttttaattttaaaattattttttaatacatagaaacagagttgcactctgttgcccaggctggaatgcagtggtgcgataatagctcactgcagccttgagctcctaggctcgaacagtcctcccatctcagcctccccagtagctgggactataggtgcatactaccatgcctggctagtaccccgttttcaataagcttctaaaactggtatttgtatattatttatcttatccccttggattgtaagcaccatgagtgaggactttgtc

SEQ ID NO: 99040 - DNA, 366 bp, Homo sapiens
ccctcgctcggttaccgttgactcgggctgactgcgcgcgaggcctcccgggcgcgcaccccctctcctccccccacgttacggatcagaaaacagaccccgggaggagaggggacggggggctgaaacccggcccccgaggtcaccctcccggggagcggtcgggtaggcctcggaggctctccggtccgggcccgcgccatcaacccccatgcgcagcagctgggcctgaggcctcgactacggggttggccccggcctggagggactgagggtggcgaggctcgaggcccggtgtaggggacgattctggaggctcccccggctccccgctcacggccctggacgccgctaccctgagcaggc

SEQ ID NO: 99041 - DNA, 443 bp, Homo sapiens
gcatgtgggtcatcaccaccacaatggagggtgctgtaaactaccttttgggactaaatttcaaaacgtacatttgtatttccagaaaatgttgagtatataaagcaatcactcttttaaacctgaacacgtaatagaaagccatagactttcaccgtgacttgcgatgaccttggcaaacctgactatgagctctttgacctacaatattgatgaattcctcaggagaacaagagctcacatttcctgaaggctgagtgtgtgccggcttctgctttaagtgctctataagcattcactcccatcatacaacaatcctttgagataagtcctatggttatcccaatttcctgatgaggaaactaagacgacagagattacacaacttgcccagtcacccaaacaatttcctgaggtgtccccgctagatgctcaacagttgt

SEQ ID NO: 99042 - DNA, 571 bp, Homo sapiens
cattttaatgtctgtggagtctatagtgaaatcccctttcattcctgttttagttcattttctattgctatagcaaaatacccgagagttggtagtttataaaggaaaaagatttatttggtttatggttctggaggctgagaaatctaagatgggttgccgcatgtggtgagggctttgtgctgtgtcataacatggcagagaagtgcaaggggaagcacatgtttgcaaagagaggccaaacatgagaggcatcctcactttataacaacctactcttgtgggttcacttctccaagagtgagaactcctttcagaacgacattaatccctcttaacaacctaatcacctcttaaaggtaccacctctcaacactgctacattgcagaccaagcttcaacatgagatttggtgaggacaaatgatattcaaaccatagtagtcatttttttgtgtgtgttagttttgctggaatcttgtcaattttattgatctttacaaacagtcagattttgatttgagtttttaaaaagttgtggtagaatatacacaaaatataatttgccatct

SEQ ID NO: 99043 - DNA, 508 bp, Homo sapiens
ttctccccatgtgatagcctgagatatggcctcatgggaagggaaagacctgacagcccgacgccagtaaaggggctgtgctgaggattagtaaaagaggaaggcctctttgcagttgagataagaggagggcatctgtctcccgctcatccctgggcaatggaatgtctgggtgttaaaacccaattgtatattccatatactgagataggagaaaaccgccttagggctggaggtgagacatgctggaggcaatactgctctttaaggcattgagatgtttatgtatatgcacatcaaaagcacagcacttttttctttaccttgtttatgatgcagagacatttgttcacatgttttcctgctgaacctctccccactattaccctattgacctgccacatggtagagataatgatcagtaaatactgaaggaactcggagactggtggcggcagggggaaggcagggttcctccgtatgctgagcgccagtcccctgggcccac

SEQ ID NO: 99044 - DNA, 1304 bp, Homo sapiens
ggtctgggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccatttttctgtctgcagggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggt

SEQ ID NO: 99045 - DNA, 700 bp, Homo sapiens
ggtctgggacgccgagagcccggcaacacctcagcccgagcccggcgaggtctctgggctcctggagcgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccatttttctgtctgcagggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggt

SEQ ID NO: 99046 - DNA, 272 bp, Homo sapiens
gagcaactcttgcaaactcaacaaagtgtgaagaaccaactaaatgtctctcctaatcccacttcccagccataaccactgttaacacgttaggttttctcctggcccttttcctctgtctttaaatattttcaaatatatgtcgtgtaactttttcaaagacaatgaaaagattatcatataaaatattgagttcagttgtcccactggacagagaggcaaactgagcctatgcagaggatcagagttggccagggctgcacatcaacctg

SEQ ID NO: 99047 - DNA, 299 bp, Homo sapiens
gaaaccgtcagtaaggagctctttatctttaccttcccactccaaacctacttgctagctgttcttatcattgcctcctttttctctgtcacaaaaatgtgttccatcttaatgaacacatttcattaatgtccttcttaatgaaggacagtccctttccctgtgctgtgaatcccatagtaatgacattagcttaagttttctgagcacttgctatctgccagttcctcccatgaattatcttgcttaagctttgcagtatacctgtgaaataggtggcagtagttgtcccaccatac

SEQ ID NO: 99048 - DNA, 381 bp, Homo sapiens
cccaggtatccagagctatcataaagccagcctagccttgagccaggaggccacccagcccaacactccctcccgcaagcatcctctcacagatccagccctccatgcttaaaacaattcagaggcccccagaagcgggaaggagagagaacaagtggagtcagtgttgagtctgctcgaggccattatctgctaccctggggacaactcaaggaagtttctcagatcacctgttgttggtgaaggacttaactagagaggcttggtccagggcactgatgaatgaacttacactcccgcacaggtggcagatatgcctatacagctgtactcacagcagagtaggctggggctaaaacaggtcccaacaatttgctatta

SEQ ID NO: 99049 - DNA, 151 bp, Homo sapiens
ttcctcgggcttccacaccaccagcctggtgtgatgcctggctcccaggctccaagccatgtgcctagtcagcaaatggggccccttgactagcccccagcatggctgctgtctgcacctgcaagtccattgcaccagtgcatcagttgtt

SEQ ID NO: 99050 - DNA, 191 bp, Homo sapiens
ttttataatatccctcacttcacatttttcctatttgtaccactgtgttttacaatgcagacacagaattataattacacaatttgtaaacatatacacatatcgaaaatacatgtttttaactgacaagcagtataaaattaacttgagaaccattattctagatcactgagggactttcaagctgtgct

SEQ ID NO: 99051 - DNA, 391 bp, Homo sapiens
cctttcctgaacacccaagcaatgcatcaggtacagagcaaaacaccatctgggtacaaatggcaagtccctaactttcctttcttttcatgaatagggtaggtgcacccttgattagttaaccatacccacaaatcaagtacctagatatgcattcgtttcctctaagggccatctcaaagtacagagctgctcacctccctttagagaatccagtttaaagaacacgtattgtaatcctggagagcgtcctagaaactcacaaataggtgtaactgaacacttctcccaggacttactggatttgacagatctaattcaagattgtaggaaacatcttttctctagcgggttgttgttgaaaattgaaacaatttctctagtctcacca

SEQ ID NO: 99052 - DNA, 766 bp, Homo sapiens
cttcttatggatttataaatatgatacttaaggatattaacctttgtcattataagtattttttcccagttgaaattagccttttatttttccttatacttggattttttggcggcagttgaggggagcatgttttaaaaatacgtagccctatgctgggattacaggagtgagccaccacgcccagcctatgttggttcacttttaaacactgttggttcacagtttaaaaagtattgcaaatttaacaaagcaactcttggcaacaggacagtttctgatctccttagacagctctcagcaatttagaatgttttatgaatttaacaggaggtacttctgagtgagaaagcagatttaaagtgaggaaccctgaaaatgttccttatttcggattttaggcttaattttgtgttgcctccgaagggcagagataaccaagccttctaaaacattaacggtggaaacagttacaagctggctaagagttttcttttttatagattgccttttcaattaaccagttacttactttcctgatttcctggtgtttggaattaaataataagatcattttggccagctgtggttgtttaggcactgtcgatagctgtttaaatcgagactaacacttagccattcacagcctaacaagtccccctcccacccaactgtttaaatttctctgatgttattgttgctgctgtattcaaggcaaattagaaaaccagtgtgaatggcttttctctcgttatagagataacac

SEQ ID NO: 99053 - DNA, 141 bp, Homo sapiens
cattcttcagagtttactacatgtactacatgttcatgtactcctaaacaatatataacactgctttgtatgttttaaaattttatataaatgttggctgggtgcggtggctcatgcctgtaatcccagcactttgggagg

SEQ ID NO: 99054 - DNA, 535 bp, Homo sapiens
taattaggagaaagacttgccggagtggcaggcagtgggattggtgctgctgtatcctgctgaccttggggagaacttagaactgggctcttaactcttaccaagttcatgtttactttctctgcaaagccctgtaggcactagtcccctgagctcactcttccatgaggttttaaggcaacagagaaggctcccttccccccggagtgtcctcttgcccaccccagcatctggaattctgaccatgagggctgtcgtatggggcctgctggggatgcagaaagactttctactgtcctggaggtcagcaggcacaggagtcatcttgcatgtgacgcccaccatctggagctagcaagaggatttcagggtagtgtcatcttgacagttggaggaagaaaaagtcccaagcccaagcagtgcttgaagcaagagagtagaaattagtgtgacccagtgaattctattgctgccatgatgaaaagtgctggtgcattcttggaaagattaggaacataacgagccagagaaacag

SEQ ID NO: 99055 - DNA, 812 bp, Homo sapiens
tgcactaatggattctacttcacattatataggacatgggacttcggagcttaatgggatatcgatcttcatcatgcttaatacttacttttcaagagaaagcaattgtagaccagtgtggttaagtgacggttacaagccctcatatccagtaagcagaagatgaaatataatttgatgtttgcccttgtttgaatactccatgaagatgaggaaaatacatgtttgtgtctaacagtgtctggcatgtgtgatttctattgagatggactcaatctcagagattctattctcagctgtgtccagtctactgagaggcccatcaaagattactcaaggagccgtctcatgtagaaagatgccctcataggctctcacaaactgttgcaagcatctcaaattttattgactgctgggtcttacaattcctcaccagatggctttgaacacagttcgatcatcaatctcattgatgctactgataattctgttggaacagcaggagatggctctagctcctaaacctgccactcgaaacacctgtcatcacctccaaagatctttccaatacccactggtacagttgtaactcaatcacttcgcaagacagataattgcatgtggccaaagatgtacctggtcaacaggacaggttagactatctgctctcaggtagtccctccaaatcaatggctggactcggttgttcaaaatgaataggaaatcctaaggcttatcagcaaattggaaagtcatgttcgaggtcctatcaagctaggctcctaaaagatatagtccccacctggaggagg

SEQ ID NO: 99056 - DNA, 862 bp, Homo sapiens
agcagatctgcggctgcttctgggaagtgggttgactaggaaagggcatgagaaaactatctgggatgatgaattttttctttgcttttcttttttgaggtggggtcttgctctgtcacccaggctggagtgcagtggcgggatctcagctgacggcagcctccccctcccaggctcaagtgatcctcacacctcagcctcctgagtagctgggaccacaggcatgtgctaccacatccaactagtgttttgtattttttgtagagacagagtcttgccatgttatccaagctggtcattaactcttgggctcaagcgatccaccccttgacctcccaaagtgctgggatcacaggagtgagccaccacctgcaccacctgctggaaatgttttatatcttgatatgcagttatccaagttgactgaatgcttcagatctgagcattttgttatgtgtaagttgttttttcctaaaatatttttctaggctgaggcgggaggatcacttaagcccaggagactagcctgggcaacatagtcaggccctgtctctattaaaaaaataaaaataaaaaactttaaaaaacttttcctgtgggtcaggacgtaagctatgtgtttgggacacagtatgtcatttaacttgtaagcaaattcattaaggtagatattattgtctctgccttacagatgagaaaactgaagctcagaagggttaaacaatttgctcattaagaaaggtgggattaaaacccagcactatggccgggctcagtggctcacgcccgtcttggctcccaaagtgctgggattacaggcatgagcaatgggcccagcaaattctacttcttaaaaatcaca

SEQ ID NO: 99057 - DNA, 343 bp, Homo sapiens
atgtcagttgtggcctaatactccagcctaccaagatatttttatatcttgagattgtcactcctgtcccttcaaaagtttgttccatctgaatatttcaccatacaaattttcaatatcttcatctaagatgttgacaagtttttgaagagctcagagccccattttaggcctcctgagaccaccttctaggtggacctgagctcaccaatcagccccacttaaatattataattcacttcattgttctagtatctagcccacattttcctatcttattcccaaaggtattatgagaggcctttttggataatgcattactgaaatctgtaaagaaccacac

SEQ ID NO: 99058 - DNA, 405 bp, Homo sapiens
tttagtagtgtaaggtttaaattcaaaaatgctccagggagacgccaggttagactaatgaatcaacagagtcatatattttgccctgcattctttggcaaaacgtgcttcctttggcacaaagagaaacatgcagacagtgaaagcggtcttctgggagtcctgaaaactggcctgagatcatgggtcaggtggtttgtactctagcaataaaagcacttgacttgtttctcagacaattatgagctctcattctgtgcagttccgtgggcagccttccatagggtgatcaagaaagagaaagaacagcctctgttttcaagctttctcagctagaaagcttcatctccttctaaccttcctagttgaaatcaaagggctaatgttgcctcgcccaagccaggg

SEQ ID NO: 99059 - DNA, 344 bp, Homo sapiens
tggggtaggaaagggccacccaggccaggaacagcaaaagcacggggcacctttgggagccagccctcccagagctccctcctgtttccacacatgctcctggctgttaagggagggtgtgtgtgaggaagatcggggctgaaaaaaaggttgggtgccaggacggaagcctggaataccttgaataccatgctgggaagctgggccttgattttataggcaaggaaggaggctggagagggaaggaagcaatcagaaggtgtagagcaatggagtcacaggagcagatgtgttttaatcaattcatccaataaatattttagggactccagacactgtgcatc

SEQ ID NO: 99060 - DNA, 631 bp, Homo sapiens
cctgcctctgcctcctgagtagctgggattacagccacacgccaccaagcccagctaatttttgtatttttagtagagactgggtttcaccatgttagccaggatggtctcgatctcctgacctcgtgatccgcccacctcggcctcctaaagtgctgggattacaggcgtgagccaccatgcccggcctatgattttctaataacattttttcattagcttattttaagaatacagtatatatttaacatatgaaatacatgttaatagatggttttctttttttttttttttagagaaaaggtcttgctctgtcaccctggctggaaagcagtggcactatcacagctcactgcagcttcaaactcctaggctcacatgatcattctgcctcgagcatcctgagtagctgggactacagatgtgtgccaccattcccagcttaatcaactatttatgttatcagtaaggcttccattcaacagcaggctcttaaggttctgaggagttatacgtggatctttgactgaggggtagtcagtccccctaataactgcgctgttcaagggttaatggtacttaacattgtcaactactggtacaagctgaacatcccaaatccaaaaatcca

SEQ ID NO: 99061 - DNA, 100 bp, Homo sapiens
cacattcctttagctcccagctactcagtaggctgaggcaggagaactacacaaaactgggaggcagaggttgtagtgagcattccagcctgggcaacag

SEQ ID NO: 99062 - DNA, 348 bp, Homo sapiens
aactaaaacaaacaaaaaaatacattagcagctccaaatccaccactgtgatgcacctcaataaaattatgagtcaagcaatgattttaaaaagttttccacagatctcagaaatgctcaagaatggaagggatcactctctctgagggcagaactgtggagtagggttaaaaatggagatttgtagaaatttgtacaaggagttgccataacccaaaattgcccttcctaacgcatgcagctaggtggctgcccctagtccagtagaagacctagctcaggagaagagacatagaggtctggcaatttgaagtccccagtgaaacagccaggtccgcctgatcacgc

SEQ ID NO: 99063 - DNA, 288 bp, Homo sapiens
agatatgatcagattgctttgaggactgaagttgacttttgtggagccgataaaatgtcccttggagagactggccttgtaccttgtctacatgactcccttacaagcttcctgattttgtgtctcagctctgtcaacctgcttgaagctgcaaggaatttggtgctcggggacaggcctccacaagtccaatgaagttggctgcgtttctgattcacttctctatccaagaataaaaataggggctgatctactcaaacgatcctgggagattaaaagattttgaag

SEQ ID NO: 99064 - DNA, 328 bp, Homo sapiens
gcttagtcctattttttacaatggttttagtgttaatgttccttcattaaatatattgttaacttgtttggccaatattgtcattatacttttttttgtgaacaccgagggagattgaaatccttaggaagcaaatatttactttcacccggtaaaaaatcttgtgcccaagagctacataattatgttggagttattctttcaccatttctaccgcctattccgaagtgttcttccaccatttctaccccctattccaaagtgtcagaggacattgatactctcccagaggaagcattttacctagtgggtgtgtatggcttcttag

SEQ ID NO: 99065 - DNA, 248 bp, Homo sapiens
attgaatcagtaattagaaaaaaaaaaaaaaaaaagaacacctcacaagaaataataggactagacggttccactagtgaattctaccaaacagttaatgatgaattaacaccaatcctactaaaactattccaaaaaaacagaagaaaagggaatgtttctaacatattctgaggccgtctttacccttatacaaaaatcaaacagataccagaagaaaactatagactactatttcttgtgaagag

SEQ ID NO: 99066 - DNA, 374 bp, Homo sapiens
atcctactcaatcttgcttctcccctcaccttagctactctccatcttgccagctatgctccagccacaccagcctcatttctgtccctcaaacatgtccaactcttttccatcttgggttgtttttttgttttgttttgttttttgacagctttattgagatgtaattcacataccagaaaattcacccttttgaagcttccaagtcagtggtttttagtagactcagggtcattcaaccaatgtcactcgtttttttcttgcctaatttttagaacattttcattacctctctctcccagaaaaaacgcacatccattatcagaaaattcccattatcctctctcctccagcctatggatttgcctattttg

SEQ ID NO: 99067 - DNA, 850 bp, Homo sapiens
cggcaactgtgacacccaggcgctggcaatagagttggcagcctgatcccgggacaaaggtactgatggacatccagatactccccgccacaatcactggcaaacccactcccaaacacacagacgcacaggggcgcacgcgcgggaacacaagcacacacacagacacacaaagacacagacaacttgaaggagagcaagggacagagggatggagagatagaaacggaaggagagagagaaacagccatcgagagagagatagagaggaactggggagattgagagagagagagagagagagcaaggtggagaaggaagcagagaaagggaaagggtgagggagctacagagggagagcaacagagccttggagagggaggctctatctggtagacagggtcccctttgccagggtagggtggagggtgactgggccgggctggaacaggggggcagggcgccactgcgggaaaatcaacggagccctgagacgtgtttttacttggattggttggtggccttgggggtgcgtttcgtagcgtcattctttttttggctcctccctgtcctcttggtgctgtgggccctgaaagttgtagagtgcgcccctcactgtggcaggagcagtggcgctgagcgtgcccacgggccgcggcttgggtctctcgttttccgggtggtatggccttagacaatggcagtggcgcctggctggcccaagagcccggtccagctacgcccgcctgattccaggcgtcaccaccaacccggggccgcgacgtgggatcaggcaccccggagccgcttgcccgtggccgggctgctctccccctctacgcccaagcac

SEQ ID NO: 99068 - DNA, 157 bp, Homo sapiens
cacagggagagaaactgagacacacggagattaacaaagatagagaggaagagagagaaaggggaagagatagtaagacccagagagagagagagacagggagacagagagaaacagagaaggatgggcatggaggtttatgcctgtaatcccagca

SEQ ID NO: 99069 - DNA, 450 bp, Homo sapiens
cctctgaattgaaatgtattcatttgttcttgtagagtttattatttgttttaatcatctaaatatcttgatttttcagttcatatcatccttactaggattcaacttgattttacgaaaaacactggattaaatatgcataaaagactccaatgtgggatgtgtgctgattccagtgtatcctccagacattactgagaccaaaagtgatgcaattacattttccttttgttgcttttgcatttcttgtagtgaacctaagtccttcagatcccaataaacatacaacctaaattcttcacataccataaacacagaccttgttgtttcctgacttaaatccagttttcaaacttaggcagtgggtgaaaggagagagaagtctatgccaataatattggaaaatctcttttatgccattaatttcagttcctcaaggatcttcaatct

SEQ ID NO: 99070 - DNA, 387 bp, Homo sapiens
taaaggattctggactttggcaaaggagggaatcacccacagatctgaagcagatttgccttctgaaaagactgctctggtttcagtatagaagacatatgggatggggtcagagctgatgtggtaaaatcagttaggctacctgtgctgtgtagaggtattagtggaaatgggagaagttcatagatttaacagatttgatatttatgaggtaaaattgggaggactggaggtataattagaggtgaaagtcaaaggtagtgctttggtttccattttgtgcaactgagtagaagatgggttaggaaatagcagaatggggccacttttgagggtgaaatcaggaaggtagccttgaacatgttgaggttgagaaaggtgtgagaa

SEQ ID NO: 99071 - DNA, 386 bp, Homo sapiens
acctcctacatgcaggagcaagagagagagatgggggtagatgccacacacgtccaaacaaccagacctcgtgagaactcactatcacgagaacagcaatggggaagtctgtccccatgatcccctctccttcctccaggcccctcctccaacactagggattacagtctgacctgagatttgggtggggacacaaatccaaaccacatcacctgggctcacctgtgtcaccaaagtcacaaccatctcccatctcctcagcttccatatgcagtgaccttcctgggcctggcacagaggaagtgcctagcacctggatgggtgtgctggacagatggcggggcaggcagctgagtgggtgggtagatgggtggatggacggttgg

SEQ ID NO: 99072 - DNA, 151 bp, Homo sapiens
actacactccagcctgggtgacagagcgagaccttgtctcgaggaaaaaaaaaaagtgaataggactggatgatggattggttgaggaaaaccaagaatggttcccagagtactgaagtggtgacatttactgaggtgggaaaggtgagga

SEQ ID NO: 99073 - DNA, 214 bp, Homo sapiens
agaaggaacagtgagggcaaatgcatagaattgtgcatagatggggaacagttaagtggtcccatttgactagagcttagaatgtatggagaggggaatatgagacactgattggaagatagcccagggcagtgttgtaaaatgaaagtgaatggactacagaacggttggtctttgtagggtagtagtaggggattggttatgaggctagcat

SEQ ID NO: 99074 - DNA, 727 bp, Homo sapiens
aggggtgtgatgagacggtggggagccgcctctgccggcaacagggagactgagggaggagacaggcccagatgcacccctgtggagggaatgggaatgtggaacaggagccactgggagaccttgcgggaaggagactgagacccagcttgtctgtgaaagaggacggtgtgcgcgaatggggaagccgtgtgagcctgtgcatcagttgagattaggctcagccgtgagcaacataaacccccaggaacagcggctgaggccgtggcaaaacagcctgtttcattcttcccagtgttatctgagtctggaagccagtcagggctggtgtgacagccccgctatcccctgggatccaggggctccctccccaccctcagtgctgagcacaggatgtctgcccaggggtgctctgccgtctctcagcgcattcccccagtgcagctgaaccagagcagccttccctctggagacacaggtggatcccagtcagacagcatggctgggatgggcacagggaggaattgagtatctggacaagggctacggaggggagccaggacaagcatgaagatcactggactcagagtcaggaggtctaggcttctggccctggctctgccactgtgtgactcatgaaggttacttccctgctggaacctcactgggccatgaactagatgatcccctaaaccttctagatgccaaaatagcagctgtagcacta

SEQ ID NO: 99075 - DNA, 124 bp, Homo sapiens
taactggaaggaaagcaggtagggtgtcagctgtgtgatcttcctgggccctcaggccatgctgattgcaaccacaacctattaaataccaggtcccatctctatgctccccgactgcagacca

SEQ ID NO: 99076 - DNA, 601 bp, Homo sapiens
acatgtacatatatatttgataaaataaaaagtaatttaagagatttggtactgatacaagaataaacacatcaatgaataaaaagagagactaaaaatttaaatccaaatacattaagatttgagtatacagttgtctctcagtagctgtggggaattagttccagcaaccccctgcagatacaaaaatgcagatgctgaagtcccttatataaaatggcacagtatttgcatattatttagacatatcttctagcatatccttccatatactttatatctagattacttacaatgcctaatacaatgcctatacatcacttcatttgtgtggattcactcaatggacagcaaattcaagtttgttttttggaactttgtggaatttctttttctaaatattttggattcatagttggttgaacccatggatgtgctgggccaactgtactataaaaatggtatttcaaaccagtgaaaaagaaatatatcattcaacagtgggcagacaactgatacactattaaagaaaaaaagcatcatcccttggtgccttggtccataactcgatcttgagactaaaataaattcaagaatgatt

SEQ ID NO: 99077 - DNA, 659 bp, Homo sapiens
tgcaggggaaatcaaagcctcgaatcgtgaagaaacatgtggaggtgacacaacaattatttgctgggagtgagagaggtactcacatgctcttttcacttattgtccagaagaagaacatcacgatggaaacatacctttcactggagtcattgaatcttaactactgaataccttacccaagaagtcaatgctgaatgtcatcaacaaaggccgcaacaaccatagctgtggataagaagaatccttctcttaagacatgttgattttttgagtgtgcagggtatggagacatgaagccttaaactcgaatacaaaatccactctaagtcctcattttctcttctgtaaaatggacttatgaactgcctccctccctatgagttaatgagataacagttaaatagaatgcagggcgtaacacaggacctctcacagggactgtactcaacacgttagatgtcttaacttcatccctttctgactccagggaaagtgaaatgccagcatttttaagtagatgttacatttctacagcgaacaatcttgtctttctctgatcgtttttggttgatttttatgtatcatgtcaatggttggagcagctagttttaatgcataacacagcgctgccaattttatgctttaaacagtaaact

SEQ ID NO: 99078 - DNA, 448 bp, Homo sapiens
gctaagagatacgcatatacgaccgaggaaataggtcgaaggaattcaactcctactgcacacaaaaagagacggaggcttcaaatgactgaaattcttcagatggtttcttgtgaccactcgtaaagaaagtatttttctccagagtccaaaggcaagataaaaagtctctgacttgaaatcagaaccgatctgctgatctgctagccacagctcgtatattgccataaaccttggaaggaggatttcccaagattaggttgcaaacggcagttcttgccatcttgatgttttggaaggagccaaagatgtgaactttcacatcagccaaaactgtccgcgtccatgtcacattctctatggtaacctactcttgagccaatcactgagtttcaaccaatgaaaggcagccaattatttaaactgtgttcaaataaagcaaatgcca

SEQ ID NO: 99079 - DNA, 574 bp, Homo sapiens
attttaagctacatcaataaatcactgacatagcttactccatgacatagaatcattcattcatctgttcatcaaaatgtgccaacattgtctcctgcacagcactgacctgggggctacaccatgaacattatgaacagattacaggtccttgatgttgatgagtccacagtctaaggcaaaggaggacatttttcaacaatatgtggtggagtctataacacacatgagcacaggggaccaggaagaggaagggcctctactacactctaatggtgagagaaagacagaaatagaaaaagcttccagcaagagacagtagctaagctgataacttatagaatactgtacattttaattgggccatccataggagaatgtttacttaaagaaatactgtacatgtgtctttgtctcctagaatgagtgaactagatgaaatgaacaattagatctgtgtgtaaagataaatctcaaaatcataatactaaatgaaaaatcaaagttacagactgatgtatacattacagtgccatttaagtaagtttaaaaacatacaatagcaacacttgtt

SEQ ID NO: 99080 - DNA, 547 bp, Homo sapiens
gcaggctgaatctcaggcaggcccctccacagtcccttccgtgtctgacttccagggtcttcccagccagaaagcagccgatcaggatcccagccaatccctacccagcagtgagggcgtgctcagtaaactgtagagtgtcgtgccgagggaacgccatggcgccctgccactcacctgtgcctcctaagtaccccaggaggaagctgcacaggctccccacagtgttaacacagctctcccagcacagtctctgcccctgtccaggcccctgacgcccccaggatgatttccagcagcctcttcgttggtcttcctccctctactcctgccccaacaagtcagagggaatctatcaatacctatgtcaggccacatccctcctctgctccacgtcctcccagggctcccgctccccggccaacacggcccttctgaccctgccattcagactcacttttaagagcgagggggtgccaattagtaaacacacaggtgaacgggtgtaaaggggaagtgttctgggcaggctgcgggtgcgggcgcc

SEQ ID NO: 99081 - DNA, 442 bp, Homo sapiens
catgacagaagtacagtgggccttgtggaggttatttgtgatgcatcctggggcaaaagttcgggggtggaagagccatcaattttaaggaagaaatcatttagaaactgaaatttgggctgtgaaggtgctaagagaagaaagatgtgttccaagtattggagggagacctcttgggcctcaaagggcctctgtacagaggatgtttaacatggagtctggtgataagaatggggtagcagagctgggtgcagtgctgggcagtgttgaatgggacttgtattcagagcccaggcatcagtttacccttctaccacaggagggtgaggatgtacccggatgtgaaaggagtactctctcaccttacgtgatgcattatttcagacatttcttgagtagtaaaggcacagccaaaagggctttcctgtcatctcaggccttg

SEQ ID NO: 99082 - DNA, 353 bp, Homo sapiens
cttcaatccacatttctgtcctgctttccattaagtttacctgattagttgtgatgaatcagcccttaactatttcatggtttgtggagattggttcattcctgagtacaataggatggtgggatttttgctttaatgttcattttaaacagaattctagacgcagatctaacattcaaactgaattatgttttctgttaaaagacggtgaaatgtcttggatatatcctcaggatatgtcagtgctttctcataaaataatgtaagcaatagcatttcttatttgtagagcattttgttctgggtggaatctgtgtggtggttctaggggctggacctagggaaggtaataa

SEQ ID NO: 99083 - DNA, 367 bp, Homo sapiens
gccaactaacttgttagcttgcaagtagagtaaaatcttatactcttcactgttcttgacagtattaaaagctttaaagctcctgtccttggactcaacaattccactttaacaaatttatccaaaagaattaatctgtgttcaaaggtatatgtatcaagtatttgtttgcagcattgaaaataaatggaaccaatgtataaaagagtaaatcatggcctaaccttaaagtgtaatgcagtataccaagtgttgtcttagttctgtttgacttggaaaggtgctcgtgatgcattaagtgtaaagagcaagatgatagaattcttcccttcagctccccctgtaactgcaaatctaaatatgtgtg

SEQ ID NO: 99084 - DNA, 370 bp, Homo sapiens
tggtaggagatgggggacaagaagttagagaggcaggtaggagttcgcaccttgagatatgaaattgggttgtagagattttaaatctaaaaagacacctgtggactttgtcttagaagaatgaacaaacaaattcacaacaagtcttcctgcaggtgagattcctagtgaagtggctgagtaaaagacatgcaaatttaaaattctgatgggcaataccaaattgtactacaaaagaataacataactgatcagtgatatacaccttgggtattttattcatttaaacaaatatttgattagagggacaagaacagaaggttaaccacaaccctgactcatgagcttttgcatgatattttccttgttg

SEQ ID NO: 99085 - DNA, 190 bp, Homo sapiens
tctggggagagccagccaccttgttagtgagtccctcagtcctcatctttatatttcaggagtgtcagcttcggaaatcttgtagctcgcctcctcaattactttgcccattttcttctgactctcatggagacgatactctccaaatgtgagtctgacccaagatttggaccagtcttgacacctgaag

SEQ ID NO: 99086 - DNA, 553 bp, Homo sapiens
tgagaggattaagcatcaaagttctcaacctaggaggctgttggaaattagtgatctgatattactggatattagataaaagtttaaacatattatttaatgcattgaaggattattaagaaaataaggaaaatccccaaaaagagaaagagagaagcagtgggttgaaatgagaatagagagcagtgatttataagtgtacaagaaagcccaagatgttcagggaccaaatttaaccaccagcactgcaatcaggaatctaaaatgcaggagtacatgcacatttgcatatatgccccacatatatatttgtacacacatgtacatgtgcacacactcacacacaatgggatagctaaattcgaaactcttctatttagccagtacacttgaagagggttaaaatagtcctaggtaaatcatgcctactggcttccagaaaaaaataaacaaattttcttctggaggaaagcatccctaaattaggctctctggattcctatacattaagttcaacaaaatatgagcttattaaaaagatttaccaaacata

SEQ ID NO: 99087 - DNA, 825 bp, Homo sapiens
accctgatttattttcatcctagcacatttcagtcactacctgaagttatttgatttactttcttaatttccatttctccactctagggaatggtttttgggaaaagcattacatgatgaagaagctacaataattcaccattatgccttttccgagaatcctacagtttttaagtatccagactttgctgcaggctgggccttaagtattccacttgtaaacaagcttaccaagagactaaagagtgaatccttgaaatccgactttacaatagatttaaaacatgagattgccctctacatctgggacaaaggcggaggacctcccctgaccccagtgcctgagttttgtaccaatgacgtggacttctactgtgctaccacattccattcttttctaccgctttgtagaaagccagtgaagaagaaggatatttttgttgcagtaaaaacatgcaagaaatttcatggtgacagaattaattgagaagaaacacccgtgttctttaataaacctattagagcgaaaaaggactgaaagcctaaaggctgaggaaattgaaagcaaaatttgcacagcctgcaggacccttgctggggactgaggaaagttcttgacctttcctcacagcttcttccagcattatgcaatggaggatattttacccaacagtgtgaacttttagtggctgcaagctgcagggagccctttctgggtacctattgttaagcagacttgggagagccaggcaagtctcattgaatactatagtgactatactgaaaattccattcctactgtggatttgggaattcctaatacag

SEQ ID NO: 99088 - DNA, 855 bp, Homo sapiens
cgcggcggcagggcggcggcggcagcggcgcagctccgctccccgcgcgtctcccttccccgcgcccaggtagggcgctcagcctccgccgccaggatgcggccgcccgcctgctggtggctgctcgcgccgccggcgctgctcgcgctcctcacctgctccctggcttttggtttggcttctgaagatacaaagaaagaggtcaagcagtctcaggatttggagaaaagtggtatatcaaggaaaaatgacatagacttaaaaggaattgtattcgtcatccagagtcaaagtaattcttttcatgcaaagagagcagagcagttaaaaaaaagcatcttaaagcaggctgcagatcttacacaggagctccccagtgtcctcctccttcatcagctggctaaacaagaaggtgcatggaccatacttccgttgttaccgcacttttctgtaacatatagcagaaattcatcttggattttcttctgtgaagaagagacaagaatacagattccaaaactcttggaaaccctcagaagatatgacccctctaagcattatgccttttccgagaatcctacagtttttaagtatccagactttgctgcaggctgggccttaagtattccacttgtaaacaagcttaccaagagactaaagagtgaatccttgaaatccgactttacaatagatttaaaacatgagattgccctctacatctgggacaaaggcggaggacctcccctgaccccagtgcctgagttttgtaccaatgacgtggacttctactgtgctaccacattccattcttttctaccgctttgtgtgagtaacagaagaaaaacttctttgcat

SEQ ID NO: 99089 - DNA, 906 bp, Homo sapiens
cgcggcggcagggcggcggcggcagcggcgcagctccgctccccgcgcgtctcccttccccgcgcccaggtagggcgctcagcctccgccgccaggatgcggccgcccgcctgctggtggctgctcgcgccgccggcgctgctcgcgctcctcacctgctccctggcttttggtttggcttctgaagatacaaagaaagaggtcaagcagtctcaggatttggagaaaagtggtatatcaaggaaaaatgacatagacttaaaaggaattgtattcgtcatccagagtcaaagtaattcttttcatgcaaagagagcagagcagttaaaaaaaagcatcttaaagcaggctgcagatcttacacaggagctccccagtgtcctcctccttcatcagctggctaaacaagaaggtgcatggaccatacttccgttgttaccgcacttttctgtaacatatagcagaaattcatcttggattttcttctgtgaagaagagacaagaatacagattccaaaactcttggaaaccctcagaagatatgacccctctaaggaatggtttttgggaaaagcattacatgatgaagaagctacaataattcaccattatgccttttccgagaatcctacagtttttaagtatccagactttgctgcaggctgggccttaagtattccacttgtaaacaagcttaccaagagactaaagagtgaatccttgaaatccgactttacaatagatttaaaacatgagattgccctctacatctgggacaaaggcggaggacctcccctgaccccagtgcctgagttttgtaccaatgacgtggacttctactgtgctaccacattccattcttttctaccgctttgtgtgagtaacagaagaaaaacttctttgcat

SEQ ID NO: 99090 - DNA, 387 bp, Homo sapiens
cttaaagtataataataataaaattaaaaaaaagtcaaggaagtgaattagaggtccctagaacctccaaaaagtaatgcaaccctggatggcatcttgatattagcctggggagacctgtgtcaaacttctatcctgtagaactgtaagataacctgtgtttttcttgtaaaagatttcaacatttgctttagattcagggggttacatgtacaggtttgttacatggcatcacctagatagtgagctagtacccagtaggtagttttcctgcttttgcccccttccgtcttccccctcagtagtccccagtgtctgttgttcccatctttatgttcatgtgtatccaatgtttagctcccacttataagtgagaacgtgtagtat

SEQ ID NO: 99091 - DNA, 320 bp, Homo sapiens
ccattttgcagaccttggctaaagtgaagcattccacgggggtttgggcccttagaaacagcctgtccaactgcctccctgactttatcacactctgctgggaaaaagtccaaggaacatcagcatcacattctgcgggaacaagggccaaaatgcctcattatgggaacatcttcccaggcagcaagccatactgcccagacccgtcctgctcatacctacaagtaccccaacctgtacgaagcagtgggcactggcattaagctagtcccccacctctgtaggtcttatgctagacagaaagcctggatttgatgtag

SEQ ID NO: 99092 - DNA, 492 bp, Homo sapiens
gtcttgaacttctggcctcaagtgatctgcccgccttggcctcccgaagtgctgagattacaggcgtgagccatcacacctggccaccattgatctttctgataaaggtactttttaaaaacttacattagcagagttctttgtgtagtttattaggcactttcatgtttatgatagcatttgatcacatgtaaacttggtaacattgacaaaatcactttcattttcttttacagatatggaaattgatctcagagaggctgagatctgctcagggtcagcaagctctcaaaactgttactagtactttttcttcaaaatatgtgtgtcgagcgtttttggctgagcctggatggattgccattttgtatgtgactttttgaagtctggacagcagaagaatgtgtttggtggttgcagtcagtaactttttctattcaactttatttctgaaattaaggcagcaagtactgctgactggtcttatcattt

SEQ ID NO: 99093 - DNA, 756 bp, Homo sapiens
acgtgagggggcggggctgcctgcggaaggggccgtgcgcgtggggtcgctccgcagctgcgagttcatggcgtcccggtgctccgagccctacccggaggtctccagaatccctaccgtcaggggatgcaacggctccctgtctggtgccctctcctgctgcgaggactcggcccggggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgtgcagttcctgcggcttgccagcgccctggggcccagtcaggagcagcacgctattcttgcttcctccaaggaaatgtggcactcgttgcaggaggatgttttacagttgacgttgtcgagtcagattcaagcaggtgtgccagaccctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcaggtgagtcctgggtgtgcatgtggggtgc

SEQ ID NO: 99094 - DNA, 204 bp, Homo sapiens
tatgaaaatcttcccttatgatgagatgggaatcagatgacattcatgaagggttttttgaaaatcaaatagcatcatgcaaatattaaggacttagcattttaagataataacaaaaatatgattattgattcttaagaaagcatcttgtatttgcatgctatgtgaatagttacataaatgaataaagtaaaactgctatac

SEQ ID NO: 99095 - DNA, 602 bp, Homo sapiens
cttggcaattcttacttacttacatacatcctttctaaagtgtaaggtagtaatttaccacaagcacaggcacacttttcctcattcgttttcccagtataatttttcataatatttgcctaaattaatttgcagtattttctttattgtggctacgtaaatatttgtaagccacttgaatactgtgattgtttttcctttttcgtgtacttgtttattatattttgctgaagtattcattcgtttttaccatttgcttagttttctatatacctatcaccaattcattcctaaattatcctgtagaaatattgtaaatcctggccaggcatggtagcacatgtctgtaatcccagcactttgggaggccgaggtgggcagattaccttaggtcaggagttcaagaccagcctggccaacatggtgaaaccctatctctactaaaaatacaaaaattaaccaggcatggtggtgttcctgtaatcccagctgctcaggaggctgaggcaggagaatcacttgaacctgggaggcagaggttgcagtgagtcgagattgcgccattgcactcccgcctgggtgacagagtgagtctccgtctc

SEQ ID NO: 99096 - DNA, 688 bp, Homo sapiens
cccgcgaattcggccattatggccgatgaattcatataaaatataaccttacaccataagtttttttaaaaaatcaatgtactgttctctctaatataaaagaaaaataaaagggaagtaatttataataaaatttatttcagtatttaatgatgtggcacaactatgccataaagcataagatcaagtgtttgcatctatctgtaaatagaatcatcgtgtaatttagaaagtatgtctgctgcctatacagttgtgtgcattgttgactcatgttgtgttgccattagtggtgtaatttcttcctgaaattgcagacaactcttaggaaagctctaaacaaagaataatcaatactttctgagttggaaaagattttttaaagtcacttagtagtccaagcactcatcttattgaatcaagatatattccctgtttatcataatttcaaagatccttacttctgttgtgtgaatattattgcacatgtgatcagtagagtgggaagtgttactgggactcctaattttttcttccaggtattgcttatggctttcagctgtgtgatatctgaagcgatactctttctcaattattcaaattgaatttgtcctttcaatccttttttttatggcaacccttgaaggtccccattaggtacacccgtgggttacccccccggttatct

SEQ ID NO: 99097 - DNA, 742 bp, Homo sapiens
cccgcgaattcggccattatggccgatgaattcatataaaatataaccttacaccataagtttttttaaaaaatcaatgtactgttctctctaatataaaagaaaaataaaagggaagtaatttataataaaatttatttcagtatttaatgatgtggcacaactatgccataaagcataagatcaagtgtttgcatctatctgtaaatagaatcatcgtgtaatttagaaagtatgtctgctgcctatacagttgtgtgcattgttgactcatgttgtgttgccattagtggtgtaatttcttcctgaaattgcagacaactcttaggaaagctctaaacaaagaataatcaatactttctgagttggaaaagattttttaaagtcacttagtagtccaagcactcatcttattgaatcaagatatattccctgtttatcataatttcaaagatccttacttctgttgtgtgaatattattgcacatgtgatcagtagagtgggaagtgttactgggactcctaattttttcttccaggtattgcttatggctttcagctgtgtgatatctgaagcgatactctttctcaattattcaaatgattggccttcatctttttttaaatgcagcctgcagtaaccaatagaataccagtagtaaccagtagacacattcttcccatcgtgaacgtgagagctatatttaagtctattcaatgcctaacttaatggcacaatttt

SEQ ID NO: 99098 - DNA, 688 bp, Homo sapiens
cccgcgaattcggccattatggccgatgaattcatataaaatataaccttacaccataagtttttttaaaaaatcaatgtactgttctctctaatataaaagaaaaataaaagggaagtaatttataataaaatttatttcagtatttaatgatgtggcacaactatgccataaagcataagatcaagtgtttgcatctatctgtaaatagaatcatcgtgtaatttagaaagtatgtctgctgcctatacagttgtgtgcattgttgactcatgttgtgttgccattagtggtgtaatttcttcctgaaattgcagacaactcttaggaaagctctaaacaaagaataatcaatactttctgagttggatatattccctgtttatcataatttcaaagatccttacttctgttgtgtgaatattattgcacatgtgatcagtagagtgggaagtgttactgggactcctaattttttcttccaggtattgcttatggctttcagctgtgtgatatctgaagcgatactctttctcaattattcaaatgattggccttcatctttttttaaatgcagcctgcagtaaccaatagaataccagtagtaaccagtagacacattcttcccatcgtgaacgtgagagctatatttaagtctattcaatgcctaacttaatggcacaatttt

SEQ ID NO: 99099 - DNA, 732 bp, Homo sapiens
actagcaaataacataatgtgaggccaaattatattggaaattttttttaagtctaacaggattctaaggctgtgatgctcttagagggaacacaacagtattcattaactattgacagtagtgcttgatgtatttgagtttgggttttttttttgtttttttttttttactttgcagcttgagatttaaaaggtgtattctggactttagtgagcccttagtgaacacctgcctccttttcagataattgtgacataccatcattttagcagcatgattttaaaagtacattaacatctgtagccatgctctctaaatgtgtttgacttaattagatcaaacctgaagataccatgaaagcctggtggccaagagagagctgtaagtaagttttggggtgcttgagtacagatgttaatttattcacacaaaataaaaatatttgtcttttggaatagccgaaattagtaggcaggacaaatctcatttttttctaaatatacaatctgatatacaaaaataatttttagtcaaggcatgggcaactaatgtcagactactcattatgtactttggctttaaaatgaataatttcctttcttcgttttgttttaacagataatcccagatccagctggaaagctgaagtatttcgataaactgaattgagaaatacttcttcaagttatgatgcttgaaagttctcaataaagttcacggtttcattacca

SEQ ID NO: 99100 - DNA, 405 bp, Homo sapiens
gcggccgcctactactactactgctactgctcgaattcaagcttctaacgatgtacggggacatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaaccttggtatgaaacaatatattccgattccact

SEQ ID NO: 99101 - DNA, 1318 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattaccaaaaaaaaaaaagaaaaaagaaaaacccagaaaaaaaaaaaaaaaaaacacaaaaaccaaaaaaaaaaaaagggggggggggccaataaagatcccgccggcaggggggcccaccagtagttgacggcagacgggcatgttgtctaccaagcaaggggccccctcatagaggaggggccatcaataaaaacagcagagcgacgcgggccccaccctctaaaagaaccggatgagcggacaacacagcgccactgcgcaatctgggggaaaacacccaatcaggggggcggacaaagaggggacaacaccccgagga

SEQ ID NO: 99102 - DNA, 1340 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaatcaaacctgaagataccatgaaagcctggtggccaagagagagctataatcccagatccagctggaaagctgaagtatttcgataaactgaattgagaaatacttcttcaagttatgatgcttgaaagttctcaataaagttcacggtttcattaccaaaaaaaaaaaagccactcccccctctcgacgtagacacgtacgaccaccactactaagtgtcacagacccgacagcgagcacacccaacgcaaccaggagcggggccacaaattaacaccacggaggagaaaagttgcacaccactcgtcaagagggcgccacataggtcgataatccagcagcccgcccacacagcgcacgcaacacctgctactcgaaaacccactggggaaacgcaccacgcgggcccgcgaagacagcgccgacacgtcggaacacgtaaccaacca

SEQ ID NO: 99103 - DNA, 1286 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaatcaaacctgaagataccatgaaagcctggtggccaagagagagctgtaagtaagttttggggtgcttgagtacagatgttaatttattcacacaaaataaaaatatttgtcttttggaatagccgaaattagtaggcaggacaaatctcatttttttctaaatatacaatctgatatacaaaaataatttttagtcaaggcatgggcaactaatgtcagactactcattatgtactttggctttaaaatgaataatttcctttcttcgttttgttttaacagataatcccagatccagctggaaagctgaagtatttcgataaactgaattgagaaatacttcttcaagttatgatgcttgaaagttctcaataaagttcacggtttcattacca

SEQ ID NO: 99104 - DNA, 1043 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagaaagtctgtaagcttcaccagactgccaaagagatctaaagtttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 99105 - DNA, 777 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctctcattatgatgacaaaggaatctgactactctgatgtcttcctggg

SEQ ID NO: 99106 - DNA, 245 bp, Homo sapiens
tgccttgactaaaaattatttttgtatatcagattgtatatttagaaaaaaatgggcaactaatgtcagactactcattatgtactttggctttaaaatgaataatttcctttcttcgttttgttttaacagataatcccagatccagctggaaagctgaagtatttcgataaactgaattgagaaatacttcttcaagttatgatgcttgaaagttctcaataaagttcacggtttcattacca

SEQ ID NO: 99107 - DNA, 696 bp, Homo sapiens
catggtggctcacgcctgtaatcccagcactttgggaggccgaggcaggtagattgctcaagtccagcagtttgagactagcctgggcaacatggcgaaaccctgtttgtacaaaaaatacaaaaattagctgggcgtggtggcacacacctgtagtcccagctactcagtaggctgtggcgagaggatcacttgagcccaagaggttgaggctgcagtgagccgagatcatgccactgcacttcagcctgggcaacagagtgagatcctgtttgaaaacaaataaaaaatttattatttattttcaaaataatacatgtacatatgcacatagtttttaaaggtcagattatcttcaacaactgtaaatactctggtacatttcttagccaaaaacaaatttttaaagctgcagttttacagtgataattccaaattatacattagattgagggagggatgtccacaggtgtgtgtacgtgtgtgtgtgtgtgtgtgtgtataccattggagtaggtaggtagtgtggtgtttgttctgtatagcatccttttgtgtggatggtataggaattcacaatacataaatgagaagaaatgacctcatctctaccattcttctgttttacagaggtctcttcattattgatgacaaaggaatcctaagacaaattactctgaatgatcttcctgtggg

SEQ ID NO: 99108 - DNA, 1003 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 99109 - DNA, 1011 bp, Homo sapiens
gagagagagagagagagagagagagagagagagagagagagagagagagagagagagagagagagagactcgcgccgaattcggcacgaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 99110 - DNA, 960 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccggtttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 99111 - DNA, 1098 bp, Homo sapiens
tgccagggagctccaacagaactgagggacgaacagtaggtgcctgagagctggccgatctggtcactctctccagtgggccacaggggcccacttggtgggcagtctctgctgccagctagggcatctcagctcagcccagagcaaagacgtgtagggacataacgctttcctcaagcttcctttcccaggtccaaacttagaggcccagttttgggcctagaattcactgaggtttgtggctgtttgtccaacagtcaccatggatcaccgaagccgactacggggcacaggcctgaaccgaatccctgggactcagtcccgagccccccgagtcccactccccttccacgtgcaacaggaggccagggaaggagaagactgggagcgagagccacctcgtcagaggcctcctatctatgagccaccagaaagtgaagagctgccagataatgttatggtttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 99112 - DNA, 958 bp, Homo sapiens
gggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggtcagtatcttacacttatattcgtagaaaaaaaagaatggatttactcttaaagcatggacagataactcttgatatgatataagaatatagtcatttatcagacaattcaggaatagctttatctaagagtaatacatgtaactacacattttccaggttaaaaaaagagagaagagtaatataatcagctgctataataaaaatgcttaaggattttataggacatttcaaaataaggggaaaagttaaatgcaatagatgtgatttctatagcgaaaaccactgaattatatgcttatgataaattgggttaccataatctggaggaaaaaaatctttaaaatatgccatttc

SEQ ID NO: 99113 - DNA, 2323 bp, Homo sapiens
ggaattagcctcctcaatgaaaaagaaagagggggaggaagaggaagagaaaagaagaagaaaaccctgaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcgtcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcagtccccccaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttgagacagagtctcgccttgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaagtctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacaccc

SEQ ID NO: 99114 - DNA, 2616 bp, Homo sapiens
caatccatatgaaatgtggtggtggattcagctgaaaccatggaatgaatgggggcgaggctggggatgtggaaactgtatcccagggatcagatctagacgactcagtggatgattgcatggggtgcaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcagtccccccaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttgagacagagtctcgccttgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaagtctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcctaat

SEQ ID NO: 99115 - DNA, 790 bp, Homo sapiens
gatgggagatgtctggaggacgtggagttctgggacggggagatgtctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcctaat

SEQ ID NO: 99116 - DNA, 2732 bp, Homo sapiens
gcaagacgtgactttgcttctccttccccttctgccatgatttgtgatgcctcctcagccatgtggaactgagtcatggccggcttcaacatggggggcgacctcagggagcctgccgccagcattcccctgggctccctggcagctgttggcatctcgtggtttctgtacatcgtcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcagtccccccaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttgagacagagtctcgccttgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaagtctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcctaat

SEQ ID NO: 99117 - DNA, 2659 bp, Homo sapiens
  misc_feature (1)..(3): n is a, c, g, or t
nnngaaaaaaaaagaaagaaaagaaaaaaaaaaggattgaacacagaaagactagagtagacaagaatcacttctccattcttggttatatttccttatctttatacactactgaaatcagtttgtttcaagtattttacctgggattcttgcatctacatgaaattggcctgcagtctgcctttcttacacttttttggtcagtttatggtgtcaagattataactccattaaatgaattggaaagtgttgccttttttcctgttctccataagaatttgcgaaagattggaatgatctgtttgttaaaagtttataaagctgtctggccctggtatttattggtgggaagactttaactactataattagactattcaggaattctatttttttcttgagtcaattttgaaaaaaaatctaagcatttacccattttacaatttattagcataaagtagcttaaggaattttcttatttctaaacctctcctggatatgcatacttccttttccgatactgtttgtatcttctcactttcttttccttggccgttttaccagaagtttgtctattttatttttttaaagaaccagtcttagctttgttcattctctctgcccttctcttttatgttctgctttctgatggtttgttctgttgttttctcatttcataaattggacatttaactcattcatgttcaaggttttttctatttttagtaagtatctgagtttatttgaattacctcctttgcctcaccccatgattgagtgtatgcatgtatacaaacatgtatatatacacatttttattgcttttccattcatatctttacattatgatttatttgacctgttaattattttacagtatttttaaatgcacagacttaagagttttataaatgtatttccttttcaaaaaaattttgtaatgttaatatcactattaataagacaattttatattttgtgaatcctgataaaatgtgctgaagacacaacattaattatgtgatattcctgccaaaaatgcataacatgaacatagtagagagaaatatcagaaaaagataaaatgaggaatatcctacaaagttaccagcctatacttctcaaaaatttcaagttaaaggagactaaagtgacgtgacaagtacctgcagcacgtgtttctggactggatcttggtcaagaaagcattttttaaacttttgttctttcggacatttttgagacattcggtaaaatttgagtaaggtctgtaaattattaatagcattatatcagtgtgacttcctgattttgataataatgtcatggttccttgaaaaagtccttgttttttaggaaatagacactggagcgtttagggttaacggaatattgatatgcaactgaatcacaaaaggtttaggaaaaattatagagagagaaaatggtagagtaaatggggtcagatgttaacctttggaaaatctatgtggaggtatatggatactttgtactgttttgcagatttactgtaaatctggaatcatttcagaatagaaagtttaaaaatagcttttgttctaactaattgcatgtggtcaaagaacatgcgagtatgataaagcctgggcaaatttttatagcctttctctgcctcagctttaccatctgacttaaagtactgagaactcatccaggcacaagtatataaatatatgttgtagtaggctgaataatggcccccaagacatcaggtcctaatccatgaaccctatgttaccttacgtggaaatgaggtgtttgcagatgtgattaaattggagatcttgagatggggagattttcttggattatctaggtaggtcctaaatgcaatcacaagtgtctttaatcagaggcagggagattgcagacagaagaggagaaggcagtgtgatcatgaaggtgaggactggagtgatgcagccacaaaccaaggaatatcagtagccacaaaaaaaaaaaaaaaaaaaaggaagggtcaaggaacagattctctcctagaaattctggaggatgaagcatcccaccaacaatttgattttggtgtagtaacactcattttggacttctggtctccagggaactgtgagaataaatttctgttgttttaaaccactgagtttgtgataaatttgttccagcagccccaggaaacacaaatgtaaattgtattacctattagaggttttgtttgtttgtttagtgtcagggtctctctctgttgcccagactggagtgcagtggcgtgaccatggctcactgcagcctcaaactcctgggctcttacaagtgatcctccctcttcagcctcctgaatagctaggactataggcactggctttataatttttatttttaaagatgggggtctcagtatgttgcccaggctggtcttgaacacctggcctcctgcaatcctgcctcagcctcccaggtagctgggattctaggcatgagtcatcacacctagctagaaaatttttgagacttgttttacgtccaggtgtggccacttttttttcctttttttttttttttttgagacacggtcttgctctgtcgccactgcacttcaacctgggcgacagagtgagacaccatctcaaaaagaaaaaaa

SEQ ID NO: 99118 - DNA, 2713 bp, Homo sapiens
  misc_feature (1)..(3): n is a, c, g, or t
nnngaaaaaaaaagaaagaaaagaaaaaaaaaaggattgaacacagaaagactagagtagacaagaatcacttctccattcttggttatatttccttatctttatacactactgaaatcagtttgtttcaagtattttacctgggattcttgcatctacatgaaattggcctgcagtctgcctttcttacacttttttggtcagtttatggtgtcaagattataactccattaaatgaattggaaagtgttgccttttttcctgttctccataagaatttgcgaaagattggaatgatctgtttgttaaaagtttataaagctgtctggccctggtatttattggtgggaagactttaactactataattagactattcaggaattctatttttttcttgagtcaattttgaaaaaaaatctaagcatttacccattttacaatttattagcataaagtagcttaaggaattttcttatttctaaacctctcctggatatgcatacttccttttccgatactgtttgtatcttctcactttcttttccttggccgttttaccagaagtttgtctattttatttttttaaagaaccagtcttagctttgttcattctctctgcccttctcttttatgttctgctttctgatggtttgttctgttgttttctcatttcataaattggacatttaactcattcatgttcaaggttttttctatttttagtaagtatctgagtttatttgaattacctcctttgcctcaccccatgattgagtgtatgcatgtatacaaacatgtatatatacacatttttattgcttttccattcatatctttacattatgatttatttgacctgttaattattttacagtatttttaaatgcacagacttaagagttttataaatgtatttccttttcaaaaaaattttgtaatgttaatatcactattaataagacaattttatattttgtgaatcctgataaaatgtgctgaagacacaacattaattatgtgatattcctgccaaaaatgcataacatgaacatagtagagagaaatatcagaaaaagataaaatgaggaatatcctacaaagttaccagcctatacttctcaaaaatttcaagttaaaggagactaaagtgacgtgacaagtacctgcagcacgtgtttctggactggatcttggtcaagaaagcattttttaaacttttgttctttcggacatttttgagacattcggtaaaatttgagtaaggtctgtaaattattaatagcattatatcagtgtgacttcctgattttgataataatgtcatggttccttgaaaaagtccttgttttttaggaaatagacactggagcgtttagggttaacggaatattgatatgcaactgaatcacaaaaggtttaggaaaaattatagagagagaaaatggtagagtaaatggggtcagatgttaacctttggaaaatctatgtggaggtatatggatactttgtactgttttgcagatttactgtaaatctggaatcatttcagaatagaaagtttaaaaatagcttttgttctaactaattgcatgtggtcaaagaacatgcgagtatgataaagcctgggcaaatttttatagcctttctctgcctcagctttaccatctgaaaaatggaaataatagcacctatgtcatatattgtttgagaggaagttaagacacttaaagtactgagaactcatccaggcacaagtatataaatatatgttgtagtaggctgaataatggcccccaagacatcaggtcctaatccatgaaccctatgttaccttacgtggaaatgaggtgtttgcagatgtgattaaattggagatcttgagatggggagattttcttggattatctaggtaggtcctaaatgcaatcacaagtgtctttaatcagaggcagggagattgcagacagaagaggagaaggcagtgtgatcatgaaggtgaggactggagtgatgcagccacaaaccaaggaatatcagtagccacaaaaaaaaaaaaaaaaaaaaggaagggtcaaggaacagattctctcctagaaattctggaggatgaagcatcccaccaacaatttgattttggtgtagtaacactcattttggacttctggtctccagggaactgtgagaataaatttctgttgttttaaaccactgagtttgtgataaatttgttccagcagccccaggaaacacaaatgtaaattgtattacctattagaggttttgtttgtttgtttagtgtcagggtctctctctgttgcccagactggagtgcagtggcgtgaccatggctcactgcagcctcaaactcctgggctcttacaagtgatcctccctcttcagcctcctgaatagctaggactataggcactggctttataatttttatttttaaagatgggggtctcagtatgttgcccaggctggtcttgaacacctggcctcctgcaatcctgcctcagcctcccaggtagctgggattctaggcatgagtcatcacacctagctagaaaatttttgagacttgttttacgtccaggtgtggccacttttttttcctttttttttttttttttgagacacggtcttgctctgtcgccactgcacttcaacctgggcgacagagtgagacaccatctcaaaaagaaaaaaa

SEQ ID NO: 99119 - DNA, 131 bp, Homo sapiens
gaaaagtggtctggtaagtataaaatctgaaaaagggagtgggaaaaatcaagtatttaataggatcatgccaagatcatgcaaaaagtaaatgtcaacctaatatatggctgtcacataaacttttcccc

SEQ ID NO: 99120 - DNA, 304 bp, Homo sapiens
cgtccttagttggtttgagacttactctgtatgttgcataacaagttttggcaagagaacagacctgactatgtcaacatccagctgtacctcagtcaaacagatgggatacagaagataattggagaaaaatatcatgcactgaattcaagactgtttcttggacgtcctcggtggaaacttttgtttgatgaaatagcaaaatataacagagggaaaacagttggtgttttctgttgtggacccaattcactatccaagactctccataaactgagaaaccagaacaactcatatgggacga

SEQ ID NO: 99121 - DNA, 423 bp, Homo sapiens
tttttttcctgtgaaaacaggtttcactatttgcctacgctcatctggaactcctgggctcaagcaaaatgccttggcctccaaaaatgctatgattgcaggcttgagacaccatgcacaaccttgagaaatttaaatgagaattgttttttctttgtgtgtttagaagacacatagggattttagtaaattttactaggtagagataggatattgtgattattttaaaaattgatacataaaaatataaacctattcaggattaaatcaccatggtaactgtaattttcaaaatatggcaaaatgttcatagttattaactctagttgctagatatgagaaggttcattattcagttctcatttttggtgacttcaatttctcataataaataacaaatatttcctcaaaaagtgagttcat

SEQ ID NO: 99122 - DNA, 208 bp, Homo sapiens
aagagtaaaacttctgtgtaatactagttccctgttccacccaggttttgtattcacttgcttttaggtctaggactggagaatgcagtacatgccaataattctagtcttctctgatctgtgaacatataccttcactgacatttgtgtagttacttggagccaaaaggaaaattgtcacttagccagatttcactctcaacatttc

SEQ ID NO: 99123 - DNA, 176 bp, Homo sapiens
gccagacattgtaaattttaccttgttgggtattggatatttttgtattcctataaatattcttgagctttgttctggggcacagttcagtgacttggagacagtttaatcctcttgggtcttgcttttatgatttgttagacaggtctgctggagacccgtctgcctcacaccaa

SEQ ID NO: 99124 - DNA, 279 bp, Homo sapiens
actgccctgagaaggtggcagagagagcgcccaagccaggttctcagcccagttcttcttccgcattcaggtgcgattccaggcaagactcgtcctcccgctgtgcctcagtgtctgcctctggaaaacaatgagttgggccagtcagtctttaagactctacaaatcctaatgttctcttcatccaagaggacacgggtaggaaggggaaggtgccgcccgggccttccccctgcccactgaccctgcagccagctcatcctcctttccctcgtgccg

SEQ ID NO: 99125 - DNA, 898 bp, Homo sapiens
agccaagcctcctccctccacacacgtgttctcatccagatcagtttcgattcctgctggtggaaagcagcctcaggcagggccactgtgcaggaagagccggcctgggtgcaggcggggctccgggagtcaccccaagatgcccggctgcccttcattgtcctccgcatgacgccggtgccagagcccacgtgagcctttgccaaggagagattcagagacgtgagcagaagagcctgaagagggacttcttcaataaggcagcaggagggtttggctgatggaagatgtttcccggaggcctgttcacgctccaccctgaaagccccagggccctgaaagccccagggccgtcccctccaggttgcaggatgatccaggaacttgttctcctcagcactgtgtagatttcagcttatgagttctgtccatgttttgtgagatttatagctaagtatttaatttttcgagtgattataaacaacatagcagttttaattttagtgtctacttgttttttattactatatagaaatacaatcggttttcatatatttatgttgcatgctgtgcgcttctaaactcactagtttcggaagctgttttttgtttttagattccttaaaattttatataggggcaatcatgtcatttaaaataggaacagtttgataataatcaacctgcatgccttttattgtaagaaaatccctaaatgctgggattacaggtggtgagccaccgtgcccaaccagaaacttttttggtgatttcagatgaacttgacttttactgtaattatacctgaagtgtttgtaaacaattgtttagaacttctatttgtcatggacttatgagtttattctttggatcacatagtaagactttttttgtcttt

SEQ ID NO: 99126 - DNA, 365 bp, Homo sapiens
gcggccgcctactactactaaattcgcggccgcgtcgacgggggtggaatctttctacttgctacatgctaataactaaggtttttacagtttactgccaattagtagtgttagcagcatgcattttttaaagagtgcttctaatggtccatatatgagaacattttgtctaaaagtgtattccctgtagccataatgtattcactggcttgtgctaagagctatggtaaaacgccaaacgaaatgaaaaaggcacagggaaataaatttttgtttactaaatgggggatgcctattttaaagtcagctcttgtcagcagatgaacttgctaaactaaaaaaaaaaatccttcagtaagtcaaat

SEQ ID NO: 99127 - DNA, 136 bp, Homo sapiens
catatatattgttgcatgtatttatatatcattcatttatgttgctagaaaaacattccattgtatgaatatattagagtttgtatccattctcctgttgatgaacatttgcattgttttcagttttggatatcat

SEQ ID NO: 99128 - DNA, 417 bp, Homo sapiens
tgcgtaacttgacaagctgattctaaaatctatacggaaaatcaatgtacacagaagagtcaaaacaattttgaaaaaaaagaacaacattggagtactcacaccctaagatttacggtcttactacaaagctacaataatagagaaagccaacattgcactgtagttcctatagaggggtgaagggagggagtgggacatggtgtgaggatagtcatatagatcaactgaacagaattcagagtctagaaataacctttatatttaggtcaattgattttcaacaagagtacaaagaaaatacaatggaataatagtcttttcaacaaatggtggtgggacaactgggtatctgcctgcaaaaggaaggtggacccctacatcacaccatatgtaaaaagtaactcaaaatgaatc

SEQ ID NO: 99129 - DNA, 268 bp, Homo sapiens
gcctgtgatttgggagctacatccaaaaaatcaccactgagactgatgatacaaagctttccctctgttttcttctagtctttttacagtttcaagtcttaggttttagtgaactacattttaagtccaagtcaaagatctgaaactggaaaaggagagttatgagtggacaaagagataaacccgtttaaagaagtacagaatagctcatgatattaaatgatgttcgttgctttatttttaaaaattgtgcctgttggacatggaa

SEQ ID NO: 99130 - DNA, 329 bp, Homo sapiens
gcttacagtctagaacaagcttttccagcccacagcccaggatggctttgaatgtggcccaacacaaattcataaactttcctaaaacattatgagatctttttgtgatttgtgttttagttcatcagctatcattagtgttagtgtattttgtgtgtggcccaagataattcttccaatgtggcccagggaagcaaaaagattggacacccctggtctagaaggaaaggcaaatattaaataacctcagaaagtgatattacaaattgtggtgagttataaacacactatcaggtgttataaaggaagtgaaggaagtggtgaggaaa

SEQ ID NO: 99131 - DNA, 280 bp, Homo sapiens
acagtcacgcctccctttcctaagaaatgtggataattgtttggcagctttctcacattgcacatgtaagacaacctgttgaattgtgtactgattccaaactgtcatggatcggaatggagaactaggaatggaaaatggaatcagggactgcgtctttaaggacaaaatcaggaatcagggtgtaagactcagacgacaagaatttgcaccctatcccagtgtgaaaccagagcaagagaaaaccagctaaatagtcagaactcggacagagagcaag

SEQ ID NO: 99132 - DNA, 1187 bp, Homo sapiens
aagttgttttctttaaaggaacacctacacagaaggctgtacttaattcccaggatgctaagagtaagagacatgagctcacacacacgtagaataatgaatgtttgtctttcctagtaaggttttttcacctccctccaaattatcataaattttaaaatttgaaatataagtattcaataccctttgttgccactgtcggagcagttactgagagatgataaataataaaatgagtctggactgctatggtggttcctgtgattaaaatattatcaagacctgacagaaataatgtgaaatataattgtcactagaattatccttgatgatagggtctgtattttattcaaccttgtatctctaaagatctagttcaagtcactatacagaataggtactcaaatatttaattaatgctttgttgaaataaggggagagtacacaaaagtaacacatggaaaaccaaaattcaataatagaatgaaaaggaaagcattattagtcagaaaaaaatattttctaatgcaatcttagagaaaataaagaggcacttataattcatcatacaactaaaatcattcagtacaggactctattccctaaagtggcactaaaaacatttcaaggcagctgttctttttttttttttttttgatgggagaaggggatcaccaaatccttcacaaatctaataactatggatcttctccctagaaaaaaatggacatatgtacatgcacacaaacccacaattttgtgtgtactctcaaaaatctgggctccaggttaaaaattcctatgttaagggaaaagctagtcactttataaaggttaagggtgtaaaagtatattaagtttcccttgcacatgatgcatcatgcaggaatttaacaacaacaacaaaaaaaacctgaagcttttaaagaatttctcattcttctgtcattttgatttcaatttgcttgctatgtgaagtagtggcttcttttatgtgttgtataatttcttctgtcctttagtgtaaaattaattatgactatgattttaaagcttcaggttttttaaaaaaccatgtttaaataaaatattaggtaagcaaaaggtgaagcttacaaggaaggtgtaggaattacaaagtgaggcaaaagatcatgtttagccattctatgcaaaaatttagaaga

SEQ ID NO: 99133 - DNA, 405 bp, Homo sapiens
atgaagtctgagaaccactgttccaaaccgaggcttctaactggatgttcattcccagccatttggaaggctcagctgaaagccagtgagccagaagccagctccactgatcctgctttccagactggccattctcacaatgttccattaggcaatagggctcttcggggaaattaatagaatgtaggcttcaggaatcatcagaaagctgcagcttccctcgtcagggaagctgacgtctacatcgtcctcagtctagaacaagaataataggtgtaccttagaaaaatgtgctttcagtccatcagtaaaaagccaatattgtaaaatcctattatctttgcttcaagtgttatcaaaaaaataataataataaaataaaggcttagaagtttcactgttcaa

SEQ ID NO: 99134 - DNA, 808 bp, Homo sapiens
gcgagttttggccaacgctctaagggttttgtttgttcttccttttgtaaaatgttgccttcgagtaacacaaaggcctgtggtctgtgaacactcagcgtgcaaggatttctttgtttttcatggactctgtgtgtgtgtgcgcgtgtgtgtgtgtgtgttggttgtgggggcaagaactaggggaaaagggatgccaaaaaatgtaagcatgtagtttttctccgctttgttgtgaaaacaaaattgataatgtaacttttggaatcaagtcttttgtatttagattggaacgttctaataccttattgttacaaatagacaatgtgtctgaaaagctgaatttttgagagtggatggattatttaaaataatgattcttaacccatttgtacaattctgtgttctgttacaaatgtcttttctttgtccatgtaacagtcaattcctgttctctgaaggaggaattctctcggtaatttctgagcccttctttaggtggttggccaccagggggcaagcgaagaatggcagaagccatctgacgtagccccttcatcactgcagataaactggtgatgctttcctgacacacttaatggcaaccagaggttttctgcacgtttgtgtttgtgtgtaagtgtgtggggtgagtgtgtggcagtggttatttgctgtattttgactgcataaaattgccatgctttcccctcggtctcctagaaatccttgtaggataattataacacaagaaacagatttgatggaaattctcataattctcatactctgaagcttagctcatatg

SEQ ID NO: 99135 - DNA, 458 bp, Homo sapiens
tataggttcagctggaacttgaggcactgggcaactctctggacgtcagtggcaagcccggccagaccgatgtacaaccaaccacccatgggaaagatctcctggaagtccgtggtcaccatctgggcctggatcccgaagtgcctgtctgcagcgatggccacacggttcttccccttcatggccatgatggctcctccgttataggacataatagacatgattgtgtggtatacgaggacccctccattgccggagcaattccagtaaaccgggtctagccttcactcctgcccatcatttctgacatttagactctacatagagggtcctgagattccaggcctttactcatcctgcatcccctacctacttggatgaatattaatatttacaataacagagaaaagttctccagaatgtctgggaggtgaaagaagttaaataaatggaaagtg

SEQ ID NO: 99136 - DNA, 203 bp, Homo sapiens
tgaagcgtctggtaaagaacttaaaatgagagcatcaccattgaaatcttagcaagagaagcagaatgtagtcatttgctccatgccctcattttgaagatttcaaagtttgagaaaaaaacccactatgattatgattgtatcaaataaatgagccagagcataatgtgccctggaggttgggccttgctgtacctcactgg

SEQ ID NO: 99137 - DNA, 205 bp, Homo sapiens
ggatccaagccaccacatggatgtgcaatacagcagagacacagcagatctgtagtttcaggacaggccattgtataacacagtggccataaactctcccaagagtactgaacaatccagtaagattgtacttcagtacaaatccatggtctctgtacagacctattttattttatttattttgagacagagtctcgctcttgtc

SEQ ID NO: 99138 - DNA, 165 bp, Homo sapiens
acctttcccaaatccaaaaatgtttgaatcccaaaacacagctggctcagggtttcagataaagcattgtggacctgtataatattattctaggaatcctaatttaggcaccctatacttaactttcttcctgatactctctcttacctgactccatgcatctca

SEQ ID NO: 99139 - DNA, 445 bp, Homo sapiens
cttagagtgacagatcccggtcccgcccatcttccaggtccatctaggttccaggggtctgactcagtacctcacatcaggggcaacaggctgtctatgccttgccattgtgcgttgatgctggcgtctgtttccctgtccccagtcattcatccccctagtcattgccgtgctggcccacgttccccacagcaagacagcttaaagtctggctctctctaagttattttcatgatacgcttgatgcatatggatcatccttctttccagaaggaaacttggcaggctgcataagccttattcccattgatgcgccgcctttggggcctgcgggaatcattcacctgttcttgtgatgtgctggggcactaggacccacctgggttgtctcagtcattggcgcaggcacaccaagcagacgtatccaccctgacacctccctgtc

SEQ ID NO: 99140 - DNA, 542 bp, Homo sapiens
aggcctagcccaatgcctgggcacagaggttgctggcactgagggagctgcgatgggacagcccctccccaaaggcccatgcccctcagacccgtctatgcaggccagcccatgggggagggactcgggacaatggcaacttcgtcttcgagaatgatggcttgggcgtctatcacagggcagggactggtggccgtccaggctaagcctgatgctattccgacccaggcttcatgttgtgtagacagcaacaggagtttggcccctcagccccccgcaggagtcgggtggggaagcaggtgagggatgtggctgtcacacagcagccaccagccccgagaccctgtgtggccagtggcctgcctggagcccagggcaaggcaaacacggctgggctggggaggcagggtggagcgcaaggaaggacaaagccagggccccccaaatcccacagggttccagatgtgcctggggcttggagacaggaacgggtctccctaaaggctctgcaggccaccctgtgcctctgcccatgcggccgc

SEQ ID NO: 99141 - DNA, 744 bp, Homo sapiens
ctggaggagcctcaccccacagacttttgccatcacctccttctcagttgcgccaggccctcactacctctcagcctggaagagctcaacctctttctgatccctgccacctttatttttttatttttattttattttacttttgagacggagtttcactctgctgccccagctggagtgcagtggcatgatcacactgcagcctcaaccttctggtctcaagcaattctcccacctcagcctcccgagtagctgggactacaggtgcacaccaacatacccagctaatttttgtatttttgtagagacagggtcttgctatgttgcccaggctggtcttgaactcctgggttcaagtgatccaccgtgcccttgacctctgccacctttatttgatattcaagaaagcacctggttggtggggtgctattcatttatcaagtgactgctttgtcacttgactgctattctctgctccttgtatttcatctctacaactagagacgccctggccactatgccagcatggcccttgttccttccagatgaacaggagcagagcaaatagcagaggatgaaaactggcagagtggaggggctgtgcacagtgagcctccgcttaataaacacttatggaaaaatgaatggacagagtgaccgggaaggtgagagctgcagggaggaaagcagcatgacctcagcctccttctgcagccaggctggcacctgtggaccccgggggtg

SEQ ID NO: 99142 - DNA, 691 bp, Homo sapiens
ggaaaacaaagcaaatatcaggtgttggaaaaagataatttaagacctttcccaggattaaaaataggcaatcatagattcagatcacttcagtctaacaaatatgtgatctttgtctgctctttgccaaagaatgtaaaggaatgcttgcactaggctttaccttttaagatcggctaaggagtcatgacaattacaggtttttattcctaaagctttgccatctaagcagaattgaacaagagggaagagattagtcagtgactgataaaagttgaaaattctctttatcccaaatcccacatttttttttctgaagttcaactaaggatttactctctccatgaatcactgttaggttaacatatcccagagtagcattttctttattttgattttctgaagtatatattttcccaaaacttatattctagatatttgatatgtgtgtattttgtttcctaaagtaaaaattcaaaggagattattttctctatttctctatgtactgaaatgcttagcctttacaattctaggcacaatattagcatataaagtgctgttaaatgaatagctgaataactgacaagctcatcagtgcaaacagataattagaaaaatttaggacagatggtgtttttatctatttgggaatcattttacctagagaatatgtcttgttatatgtaaa

SEQ ID NO: 99143 - DNA, 498 bp, Homo sapiens
ctctggcaaatatcggcaatttattttaaaagtattaagaccctgagtgggctaaataaatcatgtccacaggcttaatctggcctttggtacccttgtatgacctctgatttctagaaacctcaggaatttcacatcagttgcatgagtcactaaggaatcataaatgagccccaaaccaatgaattataagaaagagctcatctcacatttgaggcgtaccctacctccaagaagaaaactcttctgttaactctgcagtgacaacctggcaaagaattttcccctctcgctcatattcttgtttttttgtttctcacaggggtcatcaatcagttaggaggtggccaggtcttccaaggaaatcgggatgtcaggagtcactggaactccaggtgttggttgtatctttaatagtggcagatggctttcttctcctctgcagttcttgatctttttggtgattgccagttagcttcacagcttttagtcctggag

SEQ ID NO: 99144 - DNA, 176 bp, Homo sapiens
tcctatctctaaaaaaagaaaaaaaatcaaaacttagctgggcatggtgatgtgcagctgtagtcccatctacttagaaggttgaggttaagaggatcactagagtcagggaattcaaggttgcagtgagctatgactgtgctactgcactcagcatggttgacagagtgagaatc

SEQ ID NO: 99145 - DNA, 364 bp, Homo sapiens
gcctgggagacagcgagactctgtctcaaaaacaaaaaaacaaaaaaacaaaaaaaaacaaaaactagctggatgtggtggcaagtgcctgtggtcccagctactcaggaggctgaggtgggaggatcacctgagcctgagaaggttgaggctgcagtgagctgtgattgtgccactgcactccagcctggactacagagtgagagcctatctcaaaaaaaaaaaagaaagaaaagaaaagaaaaaaagaaacctgcctgacagtacaaccaccttttaaatgatttgatgttctgcctcagatctgatcatttgcctgtgacccagcaaacccacctcgggtacaaacccatgagaagcgttc

SEQ ID NO: 99146 - DNA, 548 bp, Homo sapiens
acagcctggccacaaccccatctctgttcccctgtaccccacactgccctgtgataggatgtgataagatggtaggattgcctatactgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaa

SEQ ID NO: 99147 - DNA, 793 bp, Homo sapiens
ggttaaggaggaggatggcgccgtcctgcagatgtgcggggacgcgcgcccgccgcaacgtgaggctcataggccacacgcaactctgagcattggccaggacctgtagtagccaacaggacacttaataactgatgtataggtgcgcactgtgtgtccagagctttacgttaaccacctcactgtgtcatctcgctgaggttgtgtggtttactattactgctattagcgcatttttaagcgggaaacctgaggcatgaggaggctggagtgcagtgacgtgatctcggctcgctacaacctccacctcccagccgcctgccttggcctcccaaagtgccgagattgcaacctctgcccggccgccaccccgtctgggaagtgaggagcgtctctgcctggccgcccatcgtctgggatgtgaggagcccctctgcccggctgcccagtctgggaagtgaggagcgcctcttcccggccgccatcccgtctaggaagtgaggagcgtctctgcctggctgcccattgtctgagatgtggggattgcctctgaccccactggccccgtctgggatgtgaggagcgcctctgcccggccgcgaccctgtctaggaactgaggagtgtctctgcccgatcgccacccagtctgcgaggtgaggagcgtctctgcccggccgccccgtctgagaagtgaggagcccctccgcccggcagccaccccgtctgggaagtgaggagctcctccgcccggcagccgccccgtctgggaagtgaggagcccctccgcccgg

SEQ ID NO: 99148 - DNA, 917 bp, Homo sapiens
ggttaaggaggaggatggcgccgtcctgcagatgtgcggggacgcgcgcccgccgcaacgtgaggctcataggccacacgcaactctgagcattggccaggacctgtagtagccaacaggacacttaataactgatgtataggtgcgcactgtgtgtccagagctttacgttaaccacctcactgtgtcatctcgctgaggttgtgtggtttactattactgctattagcgcatttttaagcgggaaacctgaggcatgaggagggtttcgccgtgttgaccgggctggtctccagctcctgaccgcgagtgatctgcctgcctcggccccccgagatgccgggattgcagacggagtctcgctcactcagtgctcaatgttgcccaggctggagtgcagtgacgtgatctcggctcgctacaacctccacctcccagccgcctgccttggcctcccaaagtgccgagattgcaacctctgcccggccgccaccccgtctgggaagtgaggagcgtctctgcctggccgcccatcgtctgggatgtgaggagcccctctgcccggctgcccagtctgggaagtgaggagcgcctcttcccggccgccatcccgtctaggaagtgaggagcgtctctgcctggctgcccattgtctgagatgtggggattgcctctgaccccactggccccgtctgggatgtgaggagcgcctctgcccggccgcgaccctgtctaggaactgaggagtgtctctgcccgatcgccacccagtctgcgaggtgaggagcgtctctgcccggccgccccgtctgagaagtgaggagcccctccgcccggcagccaccccgtctgggaagtgaggagctcctccgcccggcagccgccccgtctgggaagtgaggagcccctccgcccgg

SEQ ID NO: 99149 - DNA, 381 bp, Homo sapiens
caagactaatctcttgatcttctggtggacatctggctctcctccggtgttatgggagttaccccattatctattgctatcagacatctttgacacccttattccagtccctcacccacttctgctggatatgtatctgaatgattcctcctttccagtgcacggcgcctaccttgcttatatctcgtctagcctggactcctatgtggccttcctactggttttgccacaagaatcagggtgttagactacctcctcgtatcagtaatccagaatcaatctggaaatggttaatatatgtaatgatattatctctattctgggtaaatgtgcttctgtgagctaggttggcaacccaactactgtttatagacttgtttc

SEQ ID NO: 99150 - DNA, 165 bp, Homo sapiens
cacaggaagcaagaagaatagagggactgcttatttatagatttgcagatgaatgagataaccaaaatgcacttctcgcgtatgtgaaggagcaattccattttcagacttggaaagttctccataattaagtatcacccaaccctgaaagcacactgcatccca

SEQ ID NO: 99151 - DNA, 560 bp, Homo sapiens
ccgctggttgcatcctgtttgctaatatcaaaattgccaatgtcacatcagtcaacatgtctaggactagattcagtttgggaagagctacagaagatataaatatcaggtggtgtggtacattggagccaccaaaataagtctgccatcagataaacaattaattcctcgcttttatgagcatggaattggtgctagatcataaactgactatcctcattttaccaactttccgttaattgttttctgtgtcagtttttcatatttccaagttgaaaccccctaaacacaacatttttttccactgctcattttttaccaaaattcaaacttcatgaaaccctggcatttcatcctttgccttccatcctcatggccaccatcaaagtccacatctttattatcttacatgtgaacagctgtaataacctttccagttattaattctttaaacaccacttttagcctgatgcatttcttttcaagaacctatggtatgtttatagtccagattgcattaaacctaacctttctgttatagggcccttttctgaggccct

SEQ ID NO: 99152 - DNA, 226 bp, Homo sapiens
ctcttcatatcagaactgatttggggccattggggaggagatgctgaccttctaactgtaatccaactgcacgcaactattctaaagaagatgaaagcatttttcacccctttgttgtgtaataaatacagtctttatattttgttgcattttaagtttgattttataatgatctgtgaaacaaaattgttttcaataaacagacttagttgttggttactttctt

SEQ ID NO: 99153 - DNA, 186 bp, Homo sapiens
ctcttcatatcagaactgatttggggccattggggaggagatgctgaccttctaactgtaatccaactgcacgcaactattctaaagaagatgaaagcatttttcacccctttgttgtgtaataaataccgatgcggccgaaagagcagaatgaggggttatatgtagcataaaaacagatagatc

SEQ ID NO: 99154 - DNA, 408 bp, Homo sapiens
ccctgtcaggcagaataatcggaaacaggctggcttctccgccatgacgctcaccgggctttcagggcaggggctgtcacgaagatatctggggtgtggggcaaaaggaaaaacagttcccccgggacaggagtcttgtcctctctgccgtgtgactcttgacagagggcagagaccctgcatctggagtgtgcctgtgcctctctcacctccatggtcttgctgagccgctaatgcctcagaaggcctggctcactggaaagatgaaaccaggacacagtgttcaggtctcgtttcctgggataaagtgggtactcaggtaagcagaactggataacctaggaacaagttatcaaaggcttacgcatgagaacaggccaagcagacctgcatataatttcatcagta

SEQ ID NO: 99155 - DNA, 629 bp, Homo sapiens
agactatctgtgtcagaattctaaagctcagagattctccatgctgcatcccccataccatctatatctaaggctggggtgtaaagtaagaaatggttttcaacaagcatgctagggccaccacaactaatcccactgccctgcaagcatctccagatgattttgatgcagttggtccacaggtcacagcctgaaaaactctaagaccgtcagctgatcaactacaataatattctctccagcattccagacaatggctttccaacccctttaaggactggggtttactacctactcaagcagtccatttgtcttcagtcagatgactattaaaaagttctttcatatactgggtccaaacaggactttctgaactttctggctattgttaccagttctcttttgtgcagctcagagtatttcgaggccaatggcctgagctacaagtgattgaaagggcaacttaggttcaggtgattcctcgaaagatttggtccacatgactgctcactcaccggtaaaagggcttaatgtaagccagctatattgctgactgtgcaaggatgtggggttgtctgagaatagccttcaatggcactgactgactaggagagcctcaagaatacttt

SEQ ID NO: 99156 - DNA, 337 bp, Homo sapiens
ggggggcaacatatttatgagacagcatggtctaatgaaaagaccggaagtgtgaagactggacttactggagtgattcttaactccagtgtctctgtcactccacctgtaaaatgattatttttcctaaatgtgaaatggcccaaaaaatacttcacttacagtgctattgtgcaataaattagacaaatggatgtggaagtgcagtatagaacaaaaagcactggctctgagatctacatgacgggatgatgtatatatggggtgcactggcaaaagccccagattaaaagccactagaggccgggcacggtggctcacgcctgtaatcccagca

SEQ ID NO: 99157 - DNA, 189 bp, Homo sapiens
tttttcatatatgacttttactgttttgagatagttttcttatatttttagttgaatgttttcattataaaagggtgttgaatttgtcaaatgctttatgcaccatttgatataattgtgtgggggtattttcctcttcattctgttgatgtggagtattaccttgatttttgtatgcttaaccatcct

SEQ ID NO: 99158 - DNA, 451 bp, Homo sapiens
ggcagcaccacacctgccatggcaatttgcaagtctttttaaaaaaattttattgattgattgtagagatggggtcttgctttgttgcccaggctggtcctgagctcctggcctcaagtgattttccttccttggcctcccaaatttttgggattacgtacataagccaccatgcctgaccacaatttgtggttccaagagtgtgatttttatcatcatttgggaggatgttggggcctctggcatgactgatgactgtctctgagtggagtgggctttggaagggcgatggggcttgctggacaccccattggaccgtcattttgatgtagaggcctgtggttgtcttgccctttaaatgtggtggtggaacaaactctggtttgtcacaggcatatagaatgcttttgcccctgcacagtgggtaggtatttcctgttctccctccacc

SEQ ID NO: 99159 - DNA, 758 bp, Homo sapiens
tgcccaaggcccatgtacctttcttcctccaactaggaagacccagaaagaccccgctcatgcatggacctcagagaaccaaatataatgacaatgattgttagttttttgagacagagtcttactctgttgaccaggtggaaggtcagtgatgtcgatttggctccctgcaacttccacctccagagctcaatcgatctttctacctcagcctctgagtaggtgaaaccacaggcaccagcaaccacaccacctaatttctttttggagaggaagttttgccaagattcctggcctggacaggaactcctgagctcaatcgatctgcccctgtcggccacccaaagtgctggaattagaggaatgagccattgtgcctggtctgaaatataaacatgatttgaagggattctgaaaccagctgctgccttcatctgggtgataccaatatcttcccagaggaagatgatgatttttttttgtactggatgttggggaaacagtacctgggttgtcccctgtgaaaggcctttttccaatgtccggggtgtaactggggcttcttcccacatctcacacacgtccagggcttctcctaccacctccccgacaaagacctgggtcattacagccatgtccacggcagtaacctggttctaggacactgacctgcacctgatggaatgcatcagacttttacaggatgcctctctccctttcccaccacagacacacccacactggttattctgccaacc

SEQ ID NO: 99160 - DNA, 269 bp, Homo sapiens
ggagggggatgtggaactgactctgacggggaacgggaatactgaggggacgacagaccggccaggagaaggatctggggcaatgggagactgacccagtagagaggggatactggggtgatgaggaacccaagcggtagggggggatgctggagggtgggggaattccggagaccggccggggaggaggaaggtactggggggacgtggaaccgaccctgttgaggaaacggataatgggggcggggtgataccggccgtcggagtga

SEQ ID NO: 99161 - DNA, 588 bp, Homo sapiens
  misc_feature (16)..(16): n is a, c, g, or t
cacaggagagagaaancagatgagcgacatgggagttgaactggctccaccaagaatttttaaaagggaccagggcacagtggctcacacctataatcccagcgcttggggaggtcgaggcaggtggatcacttgagtccaggagttcgagaccagcctggccaacatggtaaaacccccatctctagtaaaaatacaaaaattagcagagcaattttttttaactgctgattagtattccttcgtgtggacataccactgtgtgtttaactcttcttccattgatggacatctgggctgtttctgtttttggccattatgaataaatctgatatgaacatttaagtacagattatggtgtggacattccaatatgacattttgtttatcattttcaagagaaaaaatacattgttctttgtagagaaattctcataaaaagactgacccctgacttaccttttacaacccaccccacatctcctccttctctcctccctgttagagtcattcacttaaaacactttcattgagcatctgttgtaagtgaggttgtttcacaagctgtaacaaatcctgcttcctgaa

SEQ ID NO: 99162 - DNA, 136 bp, Homo sapiens
ctaatgtaacaatagtaagaggtgttacctttgagaggtgattaggggactctgccctcatgaatgaggttggcacccttgtgaaaaggctcagggttggccaggcgcggtggctcacgcctgtaatcccagcagt

SEQ ID NO: 99163 - DNA, 245 bp, Homo sapiens
cctcagatatcttaaagcagtcctgtggttggaaaaaattgaacactcccctaattttcttatttagtaggctgagatttgtaccaatcagtcattcttttctcatggcatacagatagaaagtgatggacagtttaatcccccaggagttagtactgcagaatcagacttcagctgagcactcatcattcttaaactcattgcaaaataagtttgtttgaaatgccaactccccaaacccgatg

SEQ ID NO: 99164 - DNA, 585 bp, Homo sapiens
ctgagcagcattcctggcctccatccacaagatacctgtagcagtgtcctgccaacggtaacaatcaagtatgtcatcagacattgcccaatgtccccagggggcaacacccctctcttggacttcagggtcaagagaatctctgctggctaccccaggacttctcattatagatttcctggagcacgcagcagaaactttgcctagcccagtggttgtttccattatctgctgccaaagtgggatttgagggtgtccgggggagggggcatggggagggcagtatgctttcaaaaacccctcccaggccaggcgtggtggctcatgcctgtaatcacaggactttgggaggccgaggctggcagatcacttgaggctgggagttagagaccaacctggctaacatggcaaaacctcgtctctactaaaaatacaaaaatcagcccggcgtggtggcgggcatctgtaatcccatctactcgggaggctgaggcaggagaattacttgaacccaggaggcagaggctgcagtgagccgagatggcaccactgcactccagcttgttgacagaatgagaccctgtg

SEQ ID NO: 99165 - DNA, 409 bp, Homo sapiens
ccccctgagtagctggaactacaggcgcatgccacccatgcccagcctaaattttgtaattttttagttgagatggggtttcaccatgttggcccaggctgatctcaaactcctgacctcaagtgatacacccgccttggcctcccaaagtgctgggattacaggcatgtgccactgctcttggccttgtttgatttattttgaaacaatgttgctaacttcatacaaacttaaaactgggtttctaccaatacttttctaatccttatttgcacaattctggctcacaagtcaaagaaggctctggcttgccttcctctgggcctgttcctgccacgaatattaaggtaattttagatggttcactgtaaaatataatacatgctaggttactctttcgttatgcaaa

SEQ ID NO: 99166 - DNA, 473 bp, Homo sapiens
gatgctcatcaatgatttataaattaatgaactcaaatagttgtagaagatttcatagggaaaaaatgcatttctcttatttggccaattgcaagccatcatatgcaataatgagaaatgttgactatgttcggacaaattaaatacagtaagaaaagaaagagccatctcagaataacggtagattgattccaatttttgtaatatagataatattgcaatagacattcatggaaaaaaatgttaagtgcatttctggttatagttgtaatgttcatttcatagaaataaattactggaccaaagaaggatataaacctcacttttgcacattttcattagcattgcctattgcaattaagcatattaataataggtgaatgtaacatctttttgttttagcatgctcactctctctctccatatatatatgcatgtgtatatgtatgtacatgtatgtgtatatataggtg

SEQ ID NO: 99167 - DNA, 327 bp, Homo sapiens
gttcttcagtgacgaaaatgtaagatttaagaaagacatattagaatttagaattattttttaaaaattctatatgagagtcatatcattaaaaagaacaggtggaaaaaagaaaggataaaaagtacctctacctctttttcctaactgccctgagaaatacgttcttcctcagaggagtggaacgccatgtgctggttgtgtaattctgaacactgcgtgagtctgcacatttaaataaagtggctagagacaaccaagaagtagagccaggccgggcacggtggctcacgcctgtaatcccagcactttgggaggcaaacacag

SEQ ID NO: 99168 - DNA, 411 bp, Homo sapiens
gagcggaaggtaaatcagccatcttaggaggtacagactacagggggccgtggcattcctcttaaccgtggcagctgctgataaatactgtgactattaacagtgaggcccgacgtcatttccttatgagagggcttctttacgtctcttcatcccaaactgggaaatgtttgggaggccgaggcagtgtggatcacgaggtcacggagatggagaccgtcctggctaacatgattgcaggtgaggatattgtggctcagagaagtaattcgacttgtccaacatcatatgcaattggtggtggagctaagtggctcagaaatcaaagatggggaaatagaggccagaagtagaagaaaatagaagaaacacacttggtgaaatgaaaattagaccctgaataaaaactgt

SEQ ID NO: 99169 - DNA, 764 bp, Homo sapiens
gccgctcactcaaggacagacggaatggcagatttagaacctggcgtccattctcaaatcccattcaacaacatgggcgggggacagtggaggggaagccatctgtcctcccttctcaccaggctgagaaaagtgggtgttgaaggtgggaccgagagaagagcccacagaccccactcagggagacttctctggggacagtggcacagagcctgctaacctgctggagcggctggagcaacggcccagtccctctgcacactgtgaatcctggcagccagggcagagatgtggaccaaagggaagtctgattaccgactatgtggcctcagagtgcccttctcctctgacgagctcccagtgctttcgtggacgtgacctcatgaggccctcacactcattccataggtattttctcaggcaagtcacagacggcatcccagcacacagggagagctgagagcctcagttctctctaaaacatgaggaagcatgcacccatcccagggtgtcggcaaagaggccatcctagacgctgcgcttctcacagctgttctggctagcagcatcggctgcttctcaaaaatgattctgagagcttaggaaaaagcgaatacctccaaagtcccaaaataagtttctagaattccacagaacagagtaacagtcctgcctcacctcctcacagatcaagggcccatgttgccttaaatcatttctaagataaaccaaaaaaggaataaaggtggcagggaagaaggaag

SEQ ID NO: 99170 - DNA, 682 bp, Homo sapiens
  misc_feature (128)..(128): n is a, c, g, or t
gcccaaaacctaaaattgaaaccaacctaagtgtccaccaacagatgcctggataaaatgtggtaccatgtaccataaaaatggaatttaatttggagagaatcagtcccaactatacagttatatgncaattaaacatgctcctgaatgacttcttagtagataatgaaaattaaggcagaaaaccagaactttatatgaaactaatgagaacaaagataccacatactagaaatctctggggcacagattattggcaccattaagagggaaatttctggcactatacactcacatccaaaattagaaagttctcaacctaatgtcacaactagaagaactagacaggtaagggccaaccaacctcaaagctagcagaagaccaaataaatataccaaagtcagagctgaactgaaggagattgaaacatgaaaaactggccatcctagacgctgcgcttctcacagctgttctggctagcagcatcggctgcttctcaaaaatgattctgagagcttaggaaaaagcgaatacctccaaagtcccaaaataagtttctagaattccacagaacagagtaacagtcctgcctcacctcctcacagatcaagggcccatgttgccttaaatcatttctaagataaaccaaaaaaggaataaaggtggcagggaagaaggaag

SEQ ID NO: 99171 - DNA, 837 bp, Homo sapiens
agcagaggccggaggaagcgccacgggcggctcagacctgaggccgcaagggcgcgccgggcgggcagggcggagggtccgatttcctccctctgaacggaaaaaaagccactttccctgggaagaactcgaagaagttggatgtctgatcttcaccttggatttgtggtctcggcccgcgggcgactcaccccacccaccaggatcccacgaagccgggccggctcagcccgctggcgccatctagtgtcgaatgaggaggcggccctctgcggctggaggggacgcttgggcgtgtgaaatctgaacggagaggattaaccaaataccatttggacttaaaagcagcttgaggccgggcgcggtggctcatgcctgtaatcccagcactttgggaggccgagacgggccgatcacgaggtcaggagatcgagaccatcccggctaacacggtgaaaccccgtctctactaaaaatacaaaaaaattagccggtgtggtggcgggcgcctgtagtcgcagctactcgggaggctgaggcagaagaatggcgtgaacccgggaggcggagcccagatcgcgccactgcactccagcctgggcgacagagcaagactgtctcaaaaaaaacaacaaaaaacagcttgaaacctcttccagccactctcccagagtgacggacatgcagaaatctgtattccagcctcaattcaagacagccttctagctgcagtcccattttcaacatttcatcagtgaaaatcctttcatttaaaaaatacttcagtgccttagtcttctcaccacaacaaaaccacacagctgtggcatggttgaa

SEQ ID NO: 99172 - DNA, 539 bp, Homo sapiens
agtttatggaaattgtagaaatgaccaatttccttattttataaatagggaagcagtgccttaacatctatgtagagctttgctcttaaagtgctttaatatattttttttgtgctgcccaaggtcacacaacccactggtactccatatttaagctcccaggagattactgtagtatctttcactacatcttatgtgcatttatttttgtggaacttgtatttaactttgcctggtactataattagctatttatttctttttgaccttctgaattgtaaactcttgaatttgggactataccttgttttctagttctgtggacaaaacagtatttgtaaatattgaataaataaaccaaatttcaatttttccttagatttaaaaattagtacagtaaagcagaagttctatatactttgactttagtttttttcttttcaaaatagtcttattgatatataattcatgtaaaagtgacttttacatgaattatatatcaatagtcgacgcggccgcgaattaatagtagtagtagt

SEQ ID NO: 99173 - DNA, 365 bp, Homo sapiens
tgctttaaagttccctggaaggacaaggacctggctctctgactccccaggctgtctcttgaaaggtccacactccaggtcaggtttttgagaagttactttaatgttttatgaaaagagaggtgtcttcacttcaactttttaatgaaaagattcatcataatgattattatctccctttcatcatacctctctccttagctctatatactttgagaatgacattattcacctttttaagtaaataggtcacatagcacagttatgagcacatgctatagaggcagccttcctggcttacatgctgccttccctacttaccagctatataattttggccatgttacttaacagtttctcatgta

SEQ ID NO: 99174 - DNA, 224 bp, Homo sapiens
ttcgagctcggcaccccagcgcactagccccattttgtaacatgctggctgcagcccactaaatagatcttgcattcccactaacaggctgtggcccacaatgtgaaaaactgctcccactgcgccttgggggtctagtggatgcaggaaggtcacctggatcctctcaagtccagccctacagtggccccagggctcacagaataagccctcagcgtagcttc

SEQ ID NO: 99175 - DNA, 308 bp, Homo sapiens
gcttggtccagagctgagttcaagtcctgaatatcctttttaattttctgtctcatcgatctgtctaatactgaccataaagtgttaaagtctcccctacccaagggaatccaggagggactgagcctgaggaaccttgcactctgacccagatactgtgcttttcccacagtcttcgcaacccgcaggccaagagactccctccagtgcctaccccagcagggtcctgggtttcaagcacaaaactagggggccgtttgggcagacaccaaactagctgcaggagttttgtttgttttttttttttt

SEQ ID NO: 99176 - DNA, 892 bp, Homo sapiens
  misc_feature (22)..(22): n is a, c, g, or t
  misc_feature (45)..(46): n is a, c, g, or t
ggggggaaaaagaggggagagnggagggagagaaagaagaaaggnngctctgatgcagctatggacattcagtcttcaactgcactttgtgctgatggtgtccaactcaagcccacacatgatacttttccttattctcccagaagtctctacactgctgaagtatggggttaaaatagaagattgttgacagatagcatactggatgtaaaggagcacatcttgggacaaaaagaagagctctgaagaataatatttcttgacagataaaaattatctgaaatgcaagtttctgtgtccataaatgttttattgaaacacagtcatgcctcttcatgtctatattgtctgtggttccctctacactacaacatcaagtccagcagttgcaatggagatatctggcctgcaaagttcaaagtatttactattttgtcatgtaagaaaaagttcactgattccttgcctacaatgctcaccaggaaagcattgtttatattgagttgggcatataaaattaacacgtttttattttgcacatagataacaattattgtcaaagaatcctgagggatataaaatataggacagaaatctgggccttgaattacacctcaaaactagcaattattaacaaatgagaacagctaacaactaaaatatgagtattgattttatatgcaatagcgtttaaaataaaggatcagatcaatgttgaaatatacgaggaaaatttcatgcagaggaaatggttgtgcttttaggctgggatcttttgttagatgtaggaagggataggtgtgatttcattgtgtagcaggaaactcaaggaaaggcaaagaggctgggtgcagtttctcacacctgcagtccaggccttttgggaggctga

SEQ ID NO: 99177 - DNA, 1037 bp, Homo sapiens
  misc_feature (53)..(53): n is a, c, g, or t
ttaatggttaagatgggtaaggtagtggataaaaagttatattttaatttttnagtctattctagaaaataggaaagtgacaatgaacattaaagctgaactcctgcattctctctcaatggagcatgaaataaggcatgtcatcatgtcagcgtatgctaggaaggatttgcttagaccccggtccttttagtatgatgcagctatggacattcagtcttcaactgcactttgtgctgatggtgtccaactcaagcccacacatgatacttttccttattctcccagaagtctctacactgctgaagtatggggttaaaatagaagattgttgacagatagcatactggatgtaaaggagcacatcttgggacaaaaagaagagctctgaagaataatatttcttgacagataaaaattatctgaaatgcaagtttctgtgtccataaatgttttattgaaacacagtcatgcctcttcatgtctatattgtctgtggttccctctacactacaacatcaagtccagcagttgcaatggagatatctggcctgcaaagttcaaagtatttactattttgtcatgtaagaaaaagttcactgattccttgcctacaatgctcaccaggaaagcattgtttatattgagttgggcatataaaattaacacgtttttattttgcacatagataacaattattgtcaaagaatcctgagggatataaaatataggacagaaatctgggccttgaattacacctcaaaactagcaattattaacaaatgagaacagctaacaactaaaatatgagtattgattttatatgcaatagcgtttaaaataaaggatcagatcaatgttgaaatatacgaggaaaatttcatgcagaggaaatggttgtgcttttaggctgggatcttttgttagatgtaggaagggataggtgtgatttcattgtgtagcaggaaactcaaggaaaggcaaagaggctgggtgcagtttctcacacctgcagtccaggccttttgggaggctga

SEQ ID NO: 99178 - DNA, 367 bp, Homo sapiens
tcaaattattttcactaatattccatttggttcctgagactgttatctcatttttattgataaagaaactcaagtcagagaagttaaataactttcttaacaacttagtgacagaatgggactaaaaactcatgccttcttatttcggtacttatattatcatatattttaaaggtttctcaggttggtagtttcccaattccaagtttcatcgtaatataatagcacctttgctactatagctgactagatggcttaggaaactagataaattactgttctaaagagtgttttttctctagctccacatgcctacctattaaagattctaataaactacccttttccctaatatcctttgagataa

SEQ ID NO: 99179 - DNA, 530 bp, Homo sapiens
catagagaaaattaaaagaaaaaaattttttagaagtgcgatctcgctattttgcccaggctggtcttgaactcctgggctcaggcttagcctcccaaagtgctgggattgcagacatgagccacagcatctggctgaaagaatgttaacatgaatacctgtgtatctccacctagattcaacatttgttaatacttttgccacatttgctttatctttacctattactgaaccatttgaatataagtagcaggcatcctggcccttcatccctgaagacctcagcacgtgtctcctaaggaatacattgtgtttccaaccacaataccattatcccacctcaacagttaatactgtttctatccatcatctcatattcaatccatattcaaatttccccaattagtccccaaatgtcttttatagagttggtattttgctacctactgggttttgatacctactgggttttatataccaggatggaatcaggtgtcttgcgttacatttgattctgtctcttggaattt

SEQ ID NO: 99180 - DNA, 2905 bp, Homo sapiens
gaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaaggaatcttctatttggttagtgccaccataccatccagacactgtttagtaatcttttgaaacttactaaaagaggtttttaataatgaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttt

SEQ ID NO: 99181 - DNA, 1518 bp, Homo sapiens
tttaattgatgctaaccatagtgatgggagatccttgcttatacaggagaacataatttattatcttattttaaaataaacattacactaaaaccccacatcatttcaagaaatgtgggcaatagtagttattttattattatacgtaacttttaaaaataacaagatagacaaaatgtttgagctacatgcacatgaaaagtgaaatttacaaaaagcttaagaaatggatccaaaagtatatttaagcacttcctctgaaaccctcataactaacaaaatatgaaaaaacaataaatgtggtttataaaccagaaagcctaaaaaatctcttctaatgctatttttattaaaaatgtttactcattaatattttaattggaactttgcatcatctcaggtagaacgtgagtctcctgtcactatatttaaacaagaatgtcctaaaagattgtctattttctgaaaatagcctctgctttcccaatggttgttgcttgcttactaaagaaatatgtaaatctttgatttaagcttttattacacagtgattccattctgccactgtgacaaaaagtatctgattgctgatcaaattctctatattcgtttcacctttcccccactctctgttaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaagaagaaaaaaaaagaatgaggaggaataagaagaggaggaggaaggaaagaagaacagaaacacaaaatcttactgtgtcattacatgacctatgattaatctcttccatcttatttacattttggataaataggtgactctattttctcaaagtaaaaaggaagatatatttacttacttgccaattatcttattgaagtgttaaagttttatttttctctggattattttaagatgtacttactattaattcattttattgaaagttgacatggtaaactatatttccaggactatagaagattcaaagatgataaaatatgtatggccttttcttcacaggctttaaaatctaatgacaatttcataagcaaccataaatttgaacatttttgatatctgtaacaatatagtactttatgtaaatggttatagcaaaaataatgccatagttctatgaggaaagaaattttaaaattcctgattcttctcctttagaaatatgtacatatttatctatctatgcatagatactatttcttgaaatatagttaaatctattatacttccatcatattaggctatatatgcatgcttctatatatatattaatatatatgttaacatacagaataaaaataaatatatatgttctactagc

SEQ ID NO: 99182 - DNA, 536 bp, Homo sapiens
gataaggacagggatctttaaaatcgaacacttgcaggcacgtatatgaaatcttgtaaaaatgtctgtttctgctttctacttaaacttatctgtctttttgtttcttttgcagcaaaaaatgctggatagaatttcttcccactgcaatttaaatgtattcttttttctgtcaattaccacaggtttagtccttatgagtggtataatccacacccttgcaaccctgactcagacgtggtggaaaacaattttaccttgctaaatagtttctggtttggagttggagctctcatgcagcaaggtatacgattcagcctgctatttcctttgggcaccatgtcccactctttgctgggggtgacagctcttgctggcacaagtcgcttgcatgggtgcctctgtgcatgtaaccataatccagcttttccatcgacctaatgcatttaggccttctcaaatcccattcaagagagattctgagaaaataattagcttttgcaaatccacatagagtatactcatctatttttttc

SEQ ID NO: 99183 - DNA, 2320 bp, Homo sapiens
gaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtaacatgctcacttttgtgatttttttggcaattgttacctcctttatctaactaataattgtcaaaagtcacaatcaattttactttttctgttctttattttccatggggtgctgagaaataatgaaattttaagaatcacattcatttattaaaatgtactgtcctgtctttgtgggcagagagcatgctggttgtgtcagtaagctataagtgttatagggattactgttttcttaaccagaatataaaagctttttaaatcaatatgataaatgaatcattgcctcacttcgaagatttctgatgaaccaaaactaaaataacatgttttactaacttgagttaataattcagttataagaaaaaccaaagtactaaaatttaaaaggaggccttttttaaggaaccaagacatttataataaacattctaactataaaaggactaccttagtattctacataatatttgtggtttttttcttgttttttcacagaataaatgtcattaccaaaag

SEQ ID NO: 99184 - DNA, 2818 bp, Homo sapiens
gaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttt

SEQ ID NO: 99185 - DNA, 2590 bp, Homo sapiens
gaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttctccatatcgagacaaaattaccatagcaattcttcagctgcaagaggaaggcaaactgcatatgatgaaggagaaatggtggaggggcaatggttgcccagaagaggagagcaaagaggccagtgccctgggggttcagaatattggtggcatcttcattgttctggcagccggcttggtgctttcagtttttgtggcagtgggagaatttttatacaaatccaaaaaaaacgctcaattggaaaagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttt

SEQ ID NO: 99186 - DNA, 757 bp, Homo sapiens
tgagaatgaagacaaaatatatccagacttatgagacacagtgaaagcattgtttaaagggaaatatatagttgtgaacacatatgttaaaaaaagaagaaagagctcaaagcagtaacctaagcttctactttaacacactggaaaaagaagagcaaacaaagcaggcagaaagaaaacaataaagattagagcagaaattaatgaaatagaaaattaaaaaaatggagaaaataggtgaaataaaaagttggttctttgacaagattcacaaacctttagctaggctgagaaaaaaagagggaagtctcaaattactaaaatgagaaatgaaagaggaggatattactatcaaccttacagaaataaaaacaattaggaccatgagcaactatatgccaaaggatgacttagatgaaatagacaaattctagaaagacacaaacttatgaaatggaagatctaaataaatttatatcaaaataagattaaaatagaaattaaaagaactactcacaaagaaaagcccagacccagatggcctcactggtgaattctatcaaacatttaggcactagttaaaaagtgatgtcagcaaaatggtggaataggaagacccaggcccttattccctcacagagaaacccacttaacaaaaatttatgaccaaactgcttttgtaagaacttcagaaactttgtaagaacaccagttaagaggttgtagcacaaagccaagaagagacatattgaagtgt

SEQ ID NO: 99187 - DNA, 394 bp, Homo sapiens
ctcttcttgctctctcttagtgggttcagagctccagcagaaaaaatgggacactgtggattgatctccagaaaaccccaaaaccagcactgaaggctccaggagattatgcctttagattgtatacaggcaccagaatgacttttgcctttataaaaatgcgtgcaagagcatgaaaactaatatttgaggaatttttttttctcactgtactttctggtcctcactgaaagcattggcagttttaaaaaatgaaatgtgatactgttatagacgtagcaaacctcacgtttcattttttccaattcattctatatctaggaacttacttagaaggagaaacaaactgtacccagaaaaaggaatgaaactggagaattcttcctcatgattc

SEQ ID NO: 99188 - DNA, 220 bp, Homo sapiens
caatctcaattactgcagaactaagagcaagcccagctaagaatacaaaagcaccctattctcatcagccattcaagaaatttaagagttcatgtatgatctgaaatcttccccagagactccacatgctacattcgtcagcctggttaccttattccttcatcagtaggaatattccaatgtggaaattaaacagctaaaaactacatcatgctcacag

SEQ ID NO: 99189 - DNA, 143 bp, Homo sapiens
cagacagttgaacttgaattaggttgtggttttgccaggtgattgtggcagaggagaaaaagcagtggcagtgccacttatatccttctgtgaaatcttcctttttttgtgtggtgtagagctagcaaatgccatttacctat

SEQ ID NO: 99190 - DNA, 402 bp, Homo sapiens
cttgcccaagggcctgagctggtggaggcagagcaggagttggatccaggcctgtctgaggcatcctgccacctccatccagacctggagcaatccctgagaagggtggctaccaccagagatgtggcagctctggtctcaggaagcatagccggaggatgtcccaggcaaccaaacagccattcatcagtaaggagccagagtgagggctgctagttcagcccccggaaggtggtccaggggcagccagtgcagaactcagcaggagctcagttccaactgagcctgatttcactccagtgtccacaagggacatcctgacctggaggtcctcggctactcaccctggggcctgctggcacagcccaggagctagcccaggcctgcctctgatggttcccc

SEQ ID NO: 99191 - DNA, 175 bp, Homo sapiens
gctgatagacacaactcagggtgctaatataccaagtgcagaggtaacacagaaggaaatgtttattgacgcacgggtaaaggaagacttctcagaggagatagtttcccatgtgcatttgttttgtttttaagtaagagacctctgctgtagttttcttgaggaggtggcaaag

SEQ ID NO: 99192 - DNA, 663 bp, Homo sapiens
aggctggagtgcagtgttacaatcatagctcactgcagcctcaaactcctgggctcacatgatcctcctgtcccaggttcctcagtagttgggactacgggtgcaagccaccacatttgactaattaaaaaaaaattgtgaagatggggtctcactatgtttcctaggctggtctcaaagaaaaagtttttatgtatgcatgaaatatccctggaaagctagacaaaatttaataacattgtgtctagggagataaactggatttctggaagtcatggatgggaggaaaaattttcactgtaaaacatttttacgctttttgatttatgaaccatatgaatctactacttgtcctaaaattttttaaaaactaaagtaagggctaggcacggtgcacatgcctataattccagcactttgggaggctgaggcagcaggattgcttgaactcaagagttcaagaccagcctgggcaacatagtgaaaccccgtctctgcaaaaaaatacaaaaattagctgggcatggtggtgcatgcctgcagtcccagacacttgggaggctgagggggtaggatcacttgagcctgggaggcggaggttgcagtgagctgagactgcgccactgccctccagcctgggtggcagagtgagaccctgtctca

SEQ ID NO: 99193 - DNA, 794 bp, Homo sapiens
ggtttcttaagcagatgaatgatgactgcataaatataatgatgtagtatctttgaaggaaatgacagaggaagaatcttttactgaaatatcaatgtaaacattttttgggggaaagttttcagttgtattatagttgattctgactatttgccataactgtattctatacacttgctgaaaacattgaattagggaatactgaatcatggctcctaagggaaagacagggttaggttcctggaagcctctggtcacaacattttcaccaactgatcaatagataaccttgttttgtttatgtttgtgtttagagacatttaatatatattgttgacttactaacatcgaactcatggccaatagcactataacctacggctgaacaaagcttatcaagtcttttctctataaggcacatcccagccttcttgcacttaggagcactagacggcatttctcagcactatacaaggggctatttaaaacagaataatcacccacaaaaagcacaacaattcaaaaaaaaatctggtactaatttagactacaaaagggacatatgtttacagtatgatagtttaaacgagtaggaagaaagtcacctgactgacctctggtaggaatgcacgtgtatgtcgggcaactcaacatttttcactgctctgtacatgttactgaatgactacaaaagtcagaaattgtgagtattgattttggggttaacaaataaattttagcaggcaggccgacttaaaaatatggaatccacaatgggaacgagattgactgta

SEQ ID NO: 99194 - DNA, 216 bp, Homo sapiens
ctctctcctgccatgtaaggtttttgctaagaaatatgctgctagccttattggaactctcatatatgtgatttatttctattctcttgctgcttttaggattctctctttgtctttgatttttgatagtttgattataatacattttgttatagtcttgtttggatagaatctgattggagacatttggtccttataccttgatattattcccca

SEQ ID NO: 99195 - DNA, 378 bp, Homo sapiens
cttttagcatcttcttacattgacgactaatcacttccaattgaagtcaggagaaagctgctcaactacactatttaatggattttgaaatatgtaaatttcctctgcacttgcatggaaatctgaaaaacacttctggaactataggttgggcttggaaaatatatctgctgcagatgtcttctgttttttttttttcatgtattcattcttttattgtccattgttttaacttgactgaatacatgatcaacaagagcactgtactcctggcaattattagaacatggactttgcatagtagaaaacattttacaccagtctatggggtactgcattgctttgtataaagttcaaaataaagatttattttcaaac

SEQ ID NO: 99196 - DNA, 263 bp, Homo sapiens
catcgaacccctctgcaactcttttcagttctatattgacaatgtcctttaattgttttgttccatctatacccactcaaccaatctagcacaagccaccacgatttattgaatagagaataggatggacaggctccttaatagtgtccccattttctctcttcctctcctaacctatgctttacccaacagagagacttatgtgcttaaaatcctttcgtggcctctgattgtgcatcaaataataaaatctaaactccttg

SEQ ID NO: 99197 - DNA, 468 bp, Homo sapiens
gtaacatggcaagtccctgtctctacaaaaaaaaaaaaaaaaaaaaatttagaactagccaggcatagtggcatacctgttgtcatagctactcaggaggctgaagtgggaggatcgctggggcccaagagttggaggttaaaatgaactgtgataacaccactgcaatacagcctggcaacagagcaagactctgtctctaaaaaaacataaaaataagtgatgaaaataattgaccattatactttagagggacttctcatataagaattttggttaggagatgaaagatatgtagactaaaagctacaaaacgttgatcaaagaaattgaaaacataaacagaaagatagcccatgttcatgggggaaaaaagaggattttggttaagcacacacactgttgcataggtactactgtccatgcttagcagacagaggcagacagggaagaagttacaaatcctag

SEQ ID NO: 99198 - DNA, 713 bp, Homo sapiens
ttccttagtctaagggcacagaatggaaaggttctcattttcctcctccaatgagaattggcaccccaacagcaggccctgggccctcggctgtgatggaggggtgtctcggggtagcagaactaaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtat

SEQ ID NO: 99199 - DNA, 370 bp, Homo sapiens
cagaactaccttaaattaatttgttgaaaggacagatggatggatggttgatggaagtagcaggcttccagcagcaggggatggagtgagtgtgtggataccgctggatcagcagaaggttataccattttagagtaactatctcggacttcggagagttcctgggtatgaaggtttggctttaattaaagtctcagcacagtgttaaatgccattttattttaggtcataattaacactaatgagatgagtggattacaaagagcacacattttgagaaagtgaaaaacaacatctgagcttggtggtttccattttcgcttttccccctcccatgctctgttcaattaaaagttttgagaaaatatta

SEQ ID NO: 99200 - DNA, 403 bp, Homo sapiens
gatgatctcactctgtcacccaggctggactgcaatgatgtaaacatggctcactgcagccttgacctcttgagatcaagcgatcctcccaccttagcctctggtgtagttgggactataggtgtggaccaccatgcccagctcattttttgaatgtttgtagagatgggcaagaaagtgagatcccactttcttgtccaggctggtctcaaactcctgggctcaaactatcctcctgtatcagactcccaaagtgctaggattataggtgtgagccacaatgcccggcctatatgcctatgcctcatttttgagtgtcactgtgtaccctagtcggtgttagacactgcaggtccccgaagaagtagaggtgactgtctgtaccttaggggcaggcacagtt

SEQ ID NO: 99201 - DNA, 347 bp, Homo sapiens
gcggccgcctactactactaaattcgcggccgcgtcgacggccgggaaagagagttcgttctgggtgggacaacataagacagtgggagatactaggcttccttcccgagagttaatgcccaactctcccactttcaagtgcaggagggagctatgtgggcagagtattcaatagatccagggccctgatttgcttatttgtaaaatggaagttaaaacatttattttacagggctgctaggagaaatcaatgagctaatacatgtggcattcatttaccatgcagaccagacatgactaggacctcaagtgtggactgaatctgacaacctatcccctggtcgacg

SEQ ID NO: 99202 - DNA, 515 bp, Homo sapiens
tccctggtaagcagggggctccgtgcaaggcgcagtggaaggaaaagtggtaaagattggttggaagaagacacttgaggttattgtctgaagctgggccctttttcttgagtttgatgtggttgtgtttctgtgtcactggtcgccacagatgattggaaattagctttttccttttaccttgtagtgcagaatgctctgttgcagttgggcagactagacgggttctctgaaccacatagtttaatctttctgttcgactttctgttaggacatgactctttcctctccttcaccccttacctccagtttttgggactaggttgggtgacctcttcctcctttgtcttcttggaaaccttacttatcctgcttctgcaaatgttgggtttctccatctcatcattgagtggattcaaagtgttgacatacacagagcaacctctactcaaggtcagattgggtcagcttttccttttcaaaagagtagtgttgctcttacttgctctttgaga

SEQ ID NO: 99203 - DNA, 1495 bp, Homo sapiens
agcggagggctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagatttccaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaaaaaaaa

SEQ ID NO: 99204 - DNA, 1584 bp, Homo sapiens
ccaggctggtacgcccccggaggtacgggaccgcggcgccgcgtccccggcccaaccatggcgtcctccgcggccggctgcgtggtgatcgttggcagaattaaaactctgtacccattgaacaacagctgctcatttcccccagccccagcccctggcatccacccttctagctttctgtctctatgggtacctcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagatttccaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaaaaaaaa

SEQ ID NO: 99205 - DNA, 1886 bp, Homo sapiens
agcggagggctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggtatgtaacttctctgcaactcactgcagagaagcatgttggctacctggagcacttgctgcccctcacctctgcagcgggtgggcctgcctctgcagctggaatctttacccttgatcttggtggttcctcattcataactttgttcatacttccatcgtgtcaccaggacaccttaaggacagggtgaccagtgaactggtagctcattgtgacttgtctctgagggactgaggtctttcaagatttggaaagctgctgttcattgagggtttattgcttttgtctttgaaagcagtttctgcacagtttgcataaacaagagcaataattacactcttgataaattatttcctctttattgtccttttttttccttctccttcttgcagacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagatttccaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaaaaaaaa

SEQ ID NO: 99206 - DNA, 1440 bp, Homo sapiens
ccaggctggtacgcccccggaggtacgggaccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagatttccaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaaaaaaaa

SEQ ID NO: 99207 - DNA, 1715 bp, Homo sapiens
ccaggctggtacgcccccggaggtacgggaccgcggcgccgcgtccccggcccaaccatggcgtcctccgcggccggctgcgtggtgatcgttggcaggaagtctgaaacagcagttggagtgtagtggttaagaggaaggactcaggagtcagattgcttggcttcatctcatagatccataacttatcacccttgtggacttaattcctccatgcctcagtttatcacttatgtaggcttaattcctccatgcctcagtttccctacatataaaatggaaatactaataacacctaccttgtagggttgttgtaaagattaacatagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagatttccaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaaaaaaaa

SEQ ID NO: 99208 - DNA, 1436 bp, Homo sapiens
agcggagggctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtccgacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagatttccaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaaaaaaaa

SEQ ID NO: 99209 - DNA, 1333 bp, Homo sapiens
agcggagggctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagatttccaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaaaaaaaa

SEQ ID NO: 99210 - DNA, 877 bp, Homo sapiens
agcggagggctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggagttggcttcagttttgggatgaagcagccctgtggtcttggaaatgccagatggacatgtctggccacaatctactgacacttacttcccctgccggaggcgtgctccctgggtcacgtgatcttattggctgggatgtcatttcaagtctacatttttaaggcattagcataatga

SEQ ID NO: 99211 - DNA, 627 bp, Homo sapiens
agcggagggctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgcgtcgacgcggccgcgaatttagtagtagtagtaggcgg

SEQ ID NO: 99212 - DNA, 641 bp, Homo sapiens
cgagggtcggcgcgccgtgtgtctcccggtgtctcgggcccgcggcgcgcaccccactcagggaccaagcggccctccccgccctcccggtccgcgcgcgcagccaatgggcgcgggacccgccctccccggagcggagggctcgcagctccgccggcgcctggtcccagcgcccgcggcgccgcgtccccggcccaaccatggcgtcctccgcggccggctgcgtggtgatcgttggcaggtaaagggctccgagccgcgctgctgcccctggagcccggggagacgccggggacgtggtgccctcgcgtggggccctcggggtgggcgccgggtcgctgtccccgccccggcctccggtcctccgaagccctgcgccctgcggcccctacggcgctggcgggctcggggagaggcgcggctggaggggcttggcaggtggaggcgccccgcggagttgggtctgcttcccgggagccagcgttgcaggaggttccgaggttgaccgcccaggccgcggggcctgcggttcctggactctgttgaatgtcgccgcgtctgcccgcaggtccacatagaagtgccaggcaccgtgttgaatgaaacgaattctggctgcgatcctgcgacgactgtgttct

SEQ ID NO: 99213 - DNA, 608 bp, Homo sapiens
tgaatactcacagtgatccttctctctgcctttccagaaaggagatgaagttgctggagcaggcaggttctctgaaaggctccctgagtgtggaagagcagctgtcactcatcagtggttgtcccaatatccaagaagcagtagagggtgccatgcacattcaggtgagtgaaggacactggcgccgcatctgtggggcctgagacattgtctcccagcctctccggaggaacagggcaggatacagagcagtggcaggtgtgggcattttgcatcttcaagggcaggattttgttttatgtgataggaaatgtgatccccaaaacaccctctatcctgggttctcatcaaactagcgtgacaatgttctgtttcaagagaccaatgccttatccgtgaggccactagggattctggtgacaatgttgtattttagaggcattaacagttttagcaaaaataggttttctggactgctaatactattttattttgttttatcatcttatcaaatgacagattatattattgttctcatatgtaattgagcaaaagcttacatcatcaaaaagaaaacctttcacttgcatgtagcctttccaacaact

SEQ ID NO: 99214 - DNA, 351 bp, Homo sapiens
gaggtcatgccactgtactccaggctgcgcgacagagcaagacttagtctaaaaaaaaaaacatccctagccttgattacatgtagtttctaccaaggagacagagagtaaacagggaatatcttatacagtatgataagtactttaaagaaagagaagccaggaacagagctagagagaggctggggttgccaccatttgtggaagaggtcaaggaaggtgtctctgagagtttgtgggaatggatgtgacctgtttggagaacagcccggaggccagtgtgcctcagcccaaacccaggtggagcatgcagctgcagggaatgtcccggctttcaatgcctcttcccac

SEQ ID NO: 99215 - DNA, 182 bp, Homo sapiens
tcaggcaatggaaagagcgcatctgctcccacacctgtgagctgaacccatcatgcaatcctcaggaaagtctgcagacaagatgccccagccaaaggctgaaatccataaatccagcaagaccccagccctgaggtcagagtgggagtgacaaggaaggactcccatgaccaggaggagaa

SEQ ID NO: 99216 - DNA, 347 bp, Homo sapiens
caagggtgacaattgttagatctgccatgcatgatgttgcgaagattcaatgagctgatactgtagctgcttagaagaagccccggtcaacacagggctgtggtgaagattcaatgaactgatactgtagctgcttagaagaagccaggtcaacatggggctgtcacggagattcaatgagctgatactgtagctgcttagaggaagcccaggtcaacatggggctgtggtgaagattcaatgagctgatactgtaacggcttagaagaagccaggtcaacatggggctgtcatggagactcaataagctgatactgtagctgcttagaagaagtccagctcaacat

SEQ ID NO: 99217 - DNA, 349 bp, Homo sapiens
aaaagcatgcctgttctgtgggcatcgtagctcaaccccacagtgagctaatggagaaacagatgatattcagagtatttgaacccaacctgcaactcctcattaatgtatgtcttcctctacttgattttccatacccccacactgctgaggaggctgagttttgagaatggacacaggaaagtagacggctgattgaactatctttgaatacattgcaagatcagcaacatgagttggggaattaccagcacctgtgatagaggggcgtgctttttggttagacagcaacttgccttaaaatacagtagaccttaggccactgaagcttaactttcagccacatcat

SEQ ID NO: 99218 - DNA, 262 bp, Homo sapiens
gcggccgcctactactactaaattcgcggccgcgtcgacctgaattttacactttaaaattgtgaattttagaggctgggcatgttggctcatgcctatagtcccagcgttttgggaagccgaggcgggtagatggcttgagttcaggagttcgagaccagcttaggcaacatagcaaaatcccatctccacaaaaaatacaaaaattagcctggcgtggtggtgcgtgcctgtagtcccagctgcttgggaggctgaggct

SEQ ID NO: 99219 - DNA, 556 bp, Homo sapiens
agggtttggtgtgggaggattctctgagtttggaaatagcgcttccaggcatcactccttcaaatgcaaacgttcaccttctctctaagagaaacttgcatgtggattcagtgccttcgtttgactaaaaattacgatacaaacaatattaacatttactagacttttttttccctactttcctcctataggaaaggaagatgtgctagggcatttacttagatgtgggtcagctggcgctagtttgtttaaggagttcctgctgtgtgccagtagcttttccgggccctagggtccttgctataaatacgttagccctgctgggcttctgaactaagggagctaaatgcttccagcttccttagtgaggcagcacggtgctgtatgcttaaatccaaggccgtggagtctgacctgcgtttttatctaaactgtgtaaggtgctggccctgggtggtttggcctcgatgagtgttaaatcgccatttaatgtgatgtcaagaaataatttggaagcacctccttgtaagatgacagagccatttaattttgagaa

SEQ ID NO: 99220 - DNA, 176 bp, Homo sapiens
atgtacctatccttgtggcccaggatgtgtagagggtctttgggtttctggagacttgctgctctggaagtgttgctgaacagggtggcagggatcagcccagttctgcttcttgtcctgggtcacactcctagtggtccttgtcatcacccctggctgcctaggacccattctgg

SEQ ID NO: 99221 - DNA, 376 bp, Homo sapiens
catcttagttcatggtaatctccttggcagcacttattgtctttgtgtgagagcaaatgatagagtcatccattcaagttaattaagagcatctgcattgcaaaactggtcactaaattgctcgccaaatttgaggcttttttcctgccaacacaaattaattttttaagtagcagcattttcaggagagaccaaataaagaaagcaacaataaagttgcctgtctagtgagatgtccccaaactatcaactttaaacatacctttgccttttatagtagttcttcacacaaactgccttaatcaaaatgcgtgtctcttgctctgtcattttatgttttgctcttagcaactaattgtatgttagacagattctt

SEQ ID NO: 99222 - DNA, 512 bp, Homo sapiens
atttcatgcattttgcctctaaaagtctagacaaccacctacttttcaggctgcattcatcagtgaaaaattactaatatcccttatgctgatgaacactctggcgtatatttagataagtgtttaaagcatcttcctagccacctgattgaggtgcttcaaatactaacttacccccagaacaagattgaagttaaattacacagcacacatccattacacagtttatatttgaagtattttaaagtaaattattgcataataagtaacagtcagcaataaattctcccatcttttgcattactttttttaaaatctgattgaaatggactattggcctctatctattctgtgcattgaacacttaaaggcatgatggggctgggttccgtggcttacactgtaatccgagcactttgagaggccaaggcaggaggatcactcaaggccagcagttcaagaccagcttgggcagcatcgcaagaccctcccccgtgcccatctctactgtc

SEQ ID NO: 99223 - DNA, 160 bp, Homo sapiens
tcaggcctgagctgaggacactacaggagccaaattagagaaggggcttgcagtcctgccatattgcatattcatggctttcttgtcccctcacccccagtataatcctttttgccaggttaacaactcactaatttcaaagcaattcatttgccaactc

SEQ ID NO: 99224 - DNA, 443 bp, Homo sapiens
tcccctcttcctggtttgtatgatattttcacttccgtgaatttactgaacctctgttcacctccctctatactccttcattctctctttaaaatgcacagtcacttctgtacaaattgaagttgttcagttcacactgaatagttctctatagcaatagtctatcactcattaaaatctctccttgccactttagtttccagctttatctttgacaccctcactatactgcagtctctatgagctggatttttgttttctcactggcacataatagagactcagtaaatacttgctgaaccttgttgatgggtcaagagtggtgcatgggttttagcccctcagccacacttctgggctgggataagcatgtttaagcatctggatgaaacatcattgctcatttcactccttaaatacctggcaagtgacaggcagctgga

SEQ ID NO: 99225 - DNA, 274 bp, Homo sapiens
gacttaaccaaccccatggggcaactctgaagttgggcaggcccttcagagttactccaatggggcaagtcagccaggtctcatacttgaccttctaactgactgtcgctgagtggaggcagttctgggaagggttaggcctcaggcaaggtggctctccatggaaatcaagctctggagtggggttgggttgtcagtcaccaacactctcagcagctggggaaagggtgccttggtcccagagaatctgggtagtgactatggcgtccattac

SEQ ID NO: 99226 - DNA, 971 bp, Homo sapiens
acaagatgaattttgttgttattcacaagggttattacatactgcccagcactgttgaggcagtctacccccagtgctgccaaggagccaagtgccccaatacaatttagtaggctactgtcactgtaaaatgatgggggaaccataattggtgtggaaacactgggttactagggagtgaaggagactgcagcaaactagatggaatgtgctccttgtaatatgttctagtaattgtgcaggatcagtgtgtacagacattcttagaatttccaggcatgtgtattttttgtagctgaggtgactgtcaaaaaataataaacaacctaaaggttttgtgtattccaatagcctttctgggatgtgcacctcaagaacattgctgcataggccaggaaaacaagcatagaaagaaggggcgggggatgtccttccaggaatgtgactttgtaacctaccatcatcctgtgtttaaatgaattcaaatcagtttcattgattaccagtatttgctgcccactgaggcaaggtgtccctccaaggtcatcaggaaagagagttaatgtagggttaccaaacctagtcaaaaacacattataccatcattataattattacaatgaacatatcagtcacctcggatttacctcaggcctttttctaagctctccctcccctctctggccctcaaggcaaccattgatttataccttcatttataataggtttgtttgtattttctataatatatgattttattaataaaatgtctttttttccagtttcattcatgatgcataattattttgagattcttcaatggagcttatatgtggtggtcattctttttattgctgagtggtatattttttatggatatactatttgttatccatttgtttataagcatttaggttttatctagttttggctattacaaataaagctgctagaaatgtaaaaacttcata

SEQ ID NO: 99227 - DNA, 1184 bp, Homo sapiens
acaagatgaattttgttgttattcacaagggttattacatactgcccagcactgttgaggcagtctacccccagtgctgccaaggagccaagtgccccaatacaatttagtaggctactgtcactgtaaaatgatgggggaaccataattggtgtggaaacactgggttactagggagtgaaggagactgcagcaaactagatggaatgtgctccttgtaatatgttctagtaattgtgcaggatcagtgtgtacagacattcttagaatttccaggcatgtgtattttttgtagctgaggtgactgtcaaaaaataataaacaacctaaaggttttgtgtattccaatagcctttctgggatgtgcacctcaagaacattgctgcataggccaggaaaacaagcatagaaagaaggggcgggggatgtccttccaggaatgtgactttgtaacctaccatcatcctgtgtttaaatgaattcaaatcagtttcattgattaccagtatttgctgcccactgaggcaaggtgtccctccaaggtcatcaggaaagagagttaatgtagggttaccaaacctagtcaaaaacacattataccatcattataattattacaatgaacatatcagtcacctcggatttacctcaggcctttttctaagctctccctcccctctctggccctcaaggcaaccattgatttataccttcatttataataggtttgtttgtattttctataatatatgattttattaataaaatgtctttttttccagtttcaaaaaaaaaaaaaaaaaaaaaaaaaaaaaaaaaaaaaaaaaaaaaaaaaaaaaaaaaaagaaaaacaaaaaaaaaaaaaacacaaaaaaaaaaaacaaagaaagaagcaacgcaacagacgacctgacgcagcgtgcacggatcgaggggcggaaggagagacgagagagacaagagtagagaggaaaacgagggagcagggcacagggagagcgggaggaaggaggcggagaggtcgaaaaaggaggaggggagggaaggaaacagggagagcgatggcagggcgaggagacgcgagagacgcccaggagagaggagacagaaacagaggaggagagatgagcgggagtagacacaaggcgatgggaggcgggaggagaaggaggaagaagagagag

SEQ ID NO: 99228 - DNA, 321 bp, Homo sapiens
aatgcatcacagggaggcatagagagctggtcattagataattgtgtggcatactgtaaaacaaaatgtttattttcaaagcacttttgaaaggaaattttgtctgtaagtactcaaaatatggacagttaatttcttatgtaagaacttgggaaattataatatcatgaattaatacttttccagacaaaaacaacaagctgagaagtcattttgcggatataagactaggaaaaatagatttatgtatatagagcctgaactttttctgcatctcctcatttctttttttttctttttctttgttttcttttctctttt

SEQ ID NO: 99229 - DNA, 2310 bp, Homo sapiens
  misc_feature (810)..(810): n is a, c, g, or t
  misc_feature (812)..(813): n is a, c, g, or t
  misc_feature (919)..(919): n is a, c, g, or t
ctatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaaagtggatctaactgtcaatggtagttatatgataatcctggagataaataagtgtcaagtgaagtattacttgaatttaggacctgaagagagagaaaggggtatgagtagttggaggggaagatttgctatgacaagctattattcagtgtggttattttgtatgacaggtaagtctacaggtatcttttgttagataaaccagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctgtctctctcaaaatatcctgttgtgctgtgtgttcacccatttttgagctgccgttgactgtggataacaaaccacagaaagtgaaacttcacataaagggggactactgtattctcataatgttaattgcttctagaattcacaangnngaattcaacttgaatcttgctaaagaagtactttattattcgatgttagtccagcaacaacttatagtgtagaaatttgcccttttgagggtgaatacacaaaggngaaagaaaacttgtgtgcccacggtccactaacagataagcttctggaggccaggagtaaaccgccctgcaggggagccatctcccagggtttccccagcagagagctgtgcccagtgccggggtctcatgcttacctatttctctgtgccagtatagtagacctgttttcaagcctagcatgagccttaagtattactggctgggagtggtggctcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgtatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccac

SEQ ID NO: 99230 - DNA, 401 bp, Homo sapiens
aacgggtgatgcggttgcgtaggggaagattcctaatttctgggccatggatcctgttgctcatgctggagtgcagtggcctgatccaaggctgccaacttcacctcctgggttcaagcgattctcccacctcagcctccgaagtatctggcatgacaggtgcttgcccaagaacctggctaatttttgtatttctagtagaggcggggtttcactgtgttggccaggtttgtctccaactccatatctcaagtgatccatttgccttggcctccaaaatgcttcttgtctcatggggtacggcttgcgtaggggaagattcctaatttctggccatggatcctgttgctcatgctggagtgcagtggcctgatccaaggctgccaaccgcatcacccgtt

SEQ ID NO: 99231 - DNA, 730 bp, Homo sapiens
ataatcaggaccaagacaccctccatgagctcaagggagagaagtaacagccagttgcaataaatcatccataagctcaagatatacggccatgcaagaagggcatcttctttgttgggttaaggtcatgacccaagcagaaatagggaaaaggcaaaataaaaagattttatatcattaggaaatcgataatcaatgctttctcttgtcagaagaacatatttttgaggaaaactacaggtagaacaaattggtttaaatatagaattcaatggtaagaatagaattaaaaaatagactggataattaagcataggtcagtacgtaaaggattaagaatttgtattttcttaccaggccaatggaagttaagacttacaggtgagtcattgtggagatctgaatgcagtgaaaggttaggggaatggagaaaagtctagagagtcagcaattatcaggagacagaagaaacggagactgttgactacttgggtatgggagccagatacaaagaaacacaaagaagaatacacaatttctgtactgagaaacttcaaggcaatggtatctttggttgatagggaactcagtataaagaacctgttccggggagaaaatatggagtctgattgtttcagtgtagagtttaagttgcctatgaaacattcatttggaatgtctaagaaggtgtatatttctatggtgtgtttactttcagaatagaaacaat

SEQ ID NO: 99232 - DNA, 370 bp, Homo sapiens
gcattttattcaaattcctctgatagttctctagtagcaggttttaggatactgttttgatccagatttctgttaaagatttagatgaggccaagcagggtggctcacgcctgcaatccgagcactttggaaggtggaggcgggcggatcacttgaggccaggagttccagacaagcctggccaacatggcaaaaccccatctctactaaaaatacaaaaattagctgggtgcagtggtgcttgcctgtagtcccagctacacgggaggctgaggtatgagaactgcttgagcctgggaggtggaggttgcagtgagctgaaatcgagccactgcagtccagcctgggtgacagagtgagactctgtctc

SEQ ID NO: 99233 - DNA, 176 bp, Homo sapiens
ttgagacaggctggagtgcagcagtgtgatcatagctcactgcccctcaaacttctgggctcaagtgatcctcctgcctcagcctccggagtcactgggattacaggtaccaggcaagaatacccacatcaacaattggaagcagtctcgtggagtgctgtggaaaggcggtggat

SEQ ID NO: 99234 - DNA, 152 bp, Homo sapiens
ttttagagaattggagactggtgcaaaaggagatgatcaagaccatgagtggggagactagtgcctttttggtgggcaaggaagaagacaggtggagggaataggcagttgaagtttaagtttcagaaaagatggaacctgggcagttagat

SEQ ID NO: 99235 - DNA, 283 bp, Homo sapiens
cagatctgctttttaggaaaatcactctggctacgtttggtgtgtcatacaatttaataggtcatttccagtacctttttctactgatgtattaaaaactttattttgcaataattttagacttacagaagtgttgcaaagatatacagaaagtgcagtacccttcagtcagcttcctctaacaataacttatgaaacttttttttttttgagcctcccaggttcaagcgattctcctgcctcagcctcccaagtagctgagactacaggcacttgccaccac

SEQ ID NO: 99236 - DNA, 714 bp, Homo sapiens
agcagtggcaacccactcgggtccccttccacactgtggaagctttgttctttctctctttgcaataaatcttgctgctgctcactctttgggtccactttgcctttatgagctgtaacactcactgcaaaggtctgcagcttcactcctgaagccagcgagaccacgaacccaccgggaggaacgaacaactccagacgcgccggcttaagagctgtaacactcaccgcgaaggtccgcagcttcactcctgagccagcgagaccacgaacccaccagaaggaagaaactccgaacacatctgaacatcagaaggaacaaactccggacacgccacctttaagaactgtaacactcaccgtgagggtccgcggcttcattcttgaagtcagtgagaccaagaacccagcaattctggacacagtagtttaccagaaaagaggggaaatggcttccaaggcagaagaaacagtgcaggcacagacatggaggcatggaagagtgcagagtgtgtgtgaactgttgggtgtggccagagcatagtggacctgaagcaaggtggagaggagtagttgtgggcaagatagagtttatggggggctagtttctgatggaacttctaactttcctcaaagatggggccaccgattagagactcaacatggcaggagtcactctattcctttcaagagatggttctaattactactcctg

SEQ ID NO: 99237 - DNA, 299 bp, Homo sapiens
gatcgactcgagccggtaccatttgtcgttattttctacctaattgaattatgatctgaaaataatctctgtactatattttttgagggcagaatttattgagggaaaaactgctacagttttcctttaagtgcccatggaaaatctctctacataactctctgtgatatgtatatatgtgtgtgtatatacatatatatgtgtgtgtgtgcatatatgacacatacattataccttgctgattatattatttagattataatttatttatatttacttttaatccacttaatctgtca

SEQ ID NO: 99238 - DNA, 331 bp, Homo sapiens
tggatggaggaagcaaagatttctctacaataaagtttcatagacagctgtataccaggctgacacttgaggccaaaccttgtttttcacagtgctgttgggagtaccactgccctatcagaagctgagagaagggaggtatattaggccattcttgcactgccttaaagaaatacctgaggctggacagtttataaagaaaagagatttaattggctcacggttctacaggttgtacaggaagcttggcaccagcatctgctctgcttctggggaagcctcagggaaattttactcatggtagaaggcaaagcaggagcttgcacttcac

SEQ ID NO: 99239 - DNA, 247 bp, Homo sapiens
tcctacaataaactaacacctgcaaattatgtaacaaaaaatgtcactgagggtttgccaacatcatcaaataaatgtccatcaataggtgaaatgttaaataatggtatatgtatgatgtgtgtaaattgtgtgtacttaatggaatactaaataattttttttaggaatgagacttttctctggagtgcagcggaatgatcaccgctcactgcagtctcaacttccaaagctcaggtggtatcag

SEQ ID NO: 99240 - DNA, 926 bp, Homo sapiens
gctagggtacattggcggtttgattacatccagatatctctctctgtgcacaggaatgaacagcactccagatggtgcagctccgtcagccttgatgcccaattgtacacaatgaatggacttcccacctggctatatgttatatgctcaaacaagaatgaccatacagcattaatgacacatataactgctacttacagacaattggatttgtgctttgtattttatggatgtataaacttacccaggctgtctgatccacccccttctcacatttagtttaataaaaaaattagaagccatcatctaagaaacccatgcaatccttgtttgtctctgaagcatccatgtatcttccattctgtgtgaatttaatgtcacctgtactcctggttttacttacttaattctcttggcaccctcattttatcattgtctatcttatctatgtaacccatcccttctattatatttagatgactaaaagtttgtttctggaactctattctgtttcattgttctattggtttatctttgcaccaatcccacattgtttcaattactctagatttttgacaagtctttcaatatagcagtatgtttaagtaaattatcaagcttagggttcttttttaagattttttttttggctatttttggccctgggtattttcatatgtatcttagaaccagtatgttgattttggcaaatattattattctgggtgtggcctatagttgaatttaaaataagcatctttatatcattggattttctagtatatgaatgtaagatacattcttatgtttactttgctcctctttaatttctctcatcaatgttgtgtaattttcaggtactgacctttcattttattttggctgtttaaggctttggtgttttttgtagaactgtaaattgtatt

SEQ ID NO: 99241 - DNA, 717 bp, Homo sapiens
cagggtcccctttctggattcctcccctttttttctctttgccttaagggctatacataatccataaccaagtagaactgaaaacagacaaaagcactcctcttctagtggatagaaatctggaatccagaaatgcttccttcttgccaaacctcaacttgttccgtgccttttttttttttttaaatgcctcttcccagcctccccaccctttcgtgatttggctgagtgaggactagctgtttggtttgccttttatcaacaatagatattcactgcttttcaggtcacattttcctttaactcttctctgtttatgagtatcacaaaagggttcttcaacatcaaggcaaaactcacactcagaatactttttaactgtggatattttgacagtatgaaacggaagtcagtggtgaagactttcgttttgaagtgacttaggtcttacatgactcaaagatggttttcctagtagtataccagcagagttgaaaatgactctgaaattgaaagtcccatactacttctaagaaacttgtaaaaagtgttggccaaatgctacaccaaacattttgcattaattattctcttaactcttcaaaacagtcctttgcaggccaggctcggtggcttatgcctgtaatcctagcacctcgtggggccgaggtaggcagatcacatgaagccaggagttcaagaccaacctggccaaca

SEQ ID NO: 99242 - DNA, 883 bp, Homo sapiens
ttccgttaggctgctggagctgtgggtgccatcttgccacgttggaggaagagcccacctgagaatgacatcaactcagagggaagtcagcagagccaagaggccgggagagatgattcctgatgacatcatccggttcctgggtgcagccatggtagagttggcctcgaacgttgtccctggcatggaggtgaccagaggccaccctcacatgtcagcagacacctccagccgtgtcattcgtgttcctggttagcaaagtttgtaggggtagtattctcagttggcattcctagctgagatgtgtagccgggaggtcaccacgctgcagggccttggaaccacttctgcctccgaggagtcccttactgatgatcataggctcctcaaggtcatcagccagggcagctttgcagaagtcaaggcagctggcccagcacattctcactgggaccaagatggctgtggaggtcaccccaacagggcagcagggctcctgcagcccccagggtctgtactgcagggtccatatgatgaaggcccttaatcacccgaagatcatcagacccacgtggctggcaccgagaacaggctgttcctagtcatggattaagccagctcgggagagctatccgacttcaccctcgaattcttcttgaagggggaagaggcctgaggcaagttccagcaaataggatattccatgcagtgaggcttccagaaggaaattatccacagggatctgaagtcagagaacttccctgaaggaggctcagcacgacatggaaacaacagacgctggctttgataccagattcaccgtaggctgaaagctgatccccttcggtgggagctcctcttatacagcctcagaactgttccc

SEQ ID NO: 99243 - DNA, 394 bp, Homo sapiens
ggggagtacacgtgtcctggagcctggaacggccatcactagcaagaataggccactccagcggaacagcgtcagaaagtccttccctccaagtgttgcaagttctggaatctctgaaggcacacctacgcagagtgttcttggctcttcctaaagctgttatcaaatcatatcttggccattggaggcggctctggacaaaaagtctttcggccacctacttggcagctagtggttttaaatttcacattttgtgcccagaagcctgcaaataccactgcaccctcagatgatacgttggccttcctgtaacctatagccagcagctgtgtcctccgactttggctttagacacccatcctccccagggagcaaattccagaacggagggtgg

SEQ ID NO: 99244 - DNA, 1050 bp, Homo sapiens
attatccactaccacacactcaagaccaacctgtgctccggaaaggaatacgtgcctgtggaaatagacagagcttaagtattttgtaacctggtgaacatactgcccaaagccacacgtttcaggaagattagctcagaaatgttcaccaattgactgaagggcagtggcgggtgaggtgatgggacagcctcagggctgcacatgaggagggctccctcccccatgcaggcttttcctccaggagctgcatcaggacctcaaggaagatcagggagaattctgagaacacccttctgtggagctgcctagagaagaagaataaatatgaaaaaatacaactctgagtaatgcatggatatttgttcatgaaaactctctctgaaagcttgtgaaggtctcgaaatacccctgattagctgaagacaaacatttaaaccctccttccacagggagttcaagcaggctggatgtgtccttctatggatgatcttccccaaccccttcctcttcccagctcatccctggctctctgtgtaaacagttctcatcagtggaatgtggttgatgaagtgacgtcttcaatttcctcatcttcttggtggtcatgttattttttttcatctgagggttaaaaactcacctgcatgcagcacatgacaggctaaaatctcttgtggacaaaacggtaacaaaggcacccaccagggttgagcatccgtgttgctgacaacgaccaccaggggtcaacgtcctcttcacaatcctgtgtcagagcatcactggaatgatttcattagcaacttcccaggagaatcagcttaaaaaatacttgtcccattttccatgcagatataacccatcccttttcctgaagaaacagagctcaatactaaatacactgaatgttgtttttgctggttttgtaagtttgtgactttatcactttctaatttctgagttaggtggaccactctacatatttctctcatgggtgtgaccagccttctggatgtcaaatataactgactttgttcgtgtaaatgtcaa

SEQ ID NO: 99245 - DNA, 606 bp, Homo sapiens
cgagggttgaaaggttcaggccgcatctgtatttattctgtttggtgttctctgagctcttcaatcggtagtttgatgttgttaaatatttttgaaaagtattgtctccatgtcactcttaactatagattatgttgtgccaataacaccatttgataacacaactttcatgtactttcacatctgcgtcagcacaatattgatgaaaagagcagtgcactgatagtcttcctgcttgggttataaggctgattataaaaaaacctgtgaattttttatcaaactactgtgctctcctagccctcagtgacttcactgatgtgagagattatatgaggtgattttttaggctcttctaattcaggaagtagtctaaaaattaggaagcaaattgcataaactaattgatactaagtcatgaatggccatttctggactttaatagtcattttcattttcaaagaggaagtaccccaaggaccaaatgactcactaattgaggcaattaaagctatacaatcaggggaagaaaagccttcaagcaaccagaaattatactatcacttatttcatccatagtaccagtcctgccttgttttctctttt

SEQ ID NO: 99246 - DNA, 407 bp, Homo sapiens
accacacccggcccaggtgtttttcaatatctaattatgcataaaaaatgaatgcagctctctctcaaactgttcattgaactaaattcttccagaacccaaagtaaggaagatttgcttgaaatctgattaacagtttatagctctaatatgttaataaatcgcacagctttttttttttttacacgattaggggagccagttaatacacgataaatggcaatgacataactggggctccatgtgccatcaaaatttggggtgctaaatcaataaatacacagacacttggtcactggctatccttaggagcctgtggctatgttgctggatgcttatgttctgtaatcctaaaatacataagttattttgatgtaccctgtattggtgacttctcagtgccctca

SEQ ID NO: 99247 - DNA, 637 bp, Homo sapiens
  misc_feature (629)..(631): n is a, c, g, or t
  misc_feature (633)..(636): n is a, c, g, or t
ctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagannnannnna

SEQ ID NO: 99248 - DNA, 217 bp, Homo sapiens
gctgtatccagcagagaggcaagctgtggagcctctctgagacacctgtggagtagggggggtctcagcaactcgccgtaggattgggttagggatcataagatgcatatgacaggtacacgctgtaaacaagtcaactgatgatatttttaaattttcttaaataggtcatttcccacatttcaggttctttcctcaaatctcaaaaagggaagaa

SEQ ID NO: 99249 - DNA, 552 bp, Homo sapiens
cttttaagagctgcatggatttggagtcttatcctcactagaagagaggaatgcacccaatggaaaagaggagagcaaccaaagtctaagctaagagcatagtttcataaagtatttcctctggcattcatagtttttgtggacacacctgatacctgaaaaaaacaatctgaatatccaaaacatcattcactgttaaaatccaggaaacatccttggatttggcacaattatggacagcgagaaacttattattggaactgtactgaacctttagctcaatatcaagttcaaaacagatacaaagctatgagcctgtatatgcagagggtagatcacacctggaagctactaacaatagtccaggtgcagacatccagaggacaactgaggacatacagtggacatggagaagagggagaagattcaacctatacataacaagcttagactcataaactcagcagtgaacacgtgtcaactccttgcgggagaggaagatgaacgaaacaaatgccggacatggagtgaatgaacactgaaaccagccag

SEQ ID NO: 99250 - DNA, 753 bp, Homo sapiens
  misc_feature (519)..(519): n is a, c, g, or t
  misc_feature (527)..(527): n is a, c, g, or t
  misc_feature (529)..(529): n is a, c, g, or t
  misc_feature (541)..(541): n is a, c, g, or t
  misc_feature (553)..(553): n is a, c, g, or t
  misc_feature (557)..(557): n is a, c, g, or t
  misc_feature (561)..(561): n is a, c, g, or t
  misc_feature (583)..(583): n is a, c, g, or t
  misc_feature (586)..(587): n is a, c, g, or t
  misc_feature (589)..(589): n is a, c, g, or t
  misc_feature (595)..(595): n is a, c, g, or t
  misc_feature (599)..(599): n is a, c, g, or t
  misc_feature (603)..(604): n is a, c, g, or t
  misc_feature (608)..(608): n is a, c, g, or t
  misc_feature (623)..(623): n is a, c, g, or t
  misc_feature (627)..(627): n is a, c, g, or t
  misc_feature (632)..(633): n is a, c, g, or t
  misc_feature (639)..(639): n is a, c, g, or t
ctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcttgcctgccctgagccgctgctttgagctccacaccttcagcttctgtggaaatcccatctgcatggccaccctggagaacctgctgagccacacaatcatactcaaaaacttatgcctggagctgtatcctgccccccccgggggagttatggtgctgatggtactctctgctggagcagatttgctcaaattagggctgagctgatgaacagagtgagggacttaaggcaccccaagaggatcttgttctgtactgactactgccctgactgtggnaacaggtnantttatgacctgnaggcaatcaatnctgntgtnaatgcctgccttttggatggtntgnnanacgctntttntggnnactnggaaactaaaacctnggcntaggnnctcctnaagggagccccaaacgatcatgacacactccgctctgcaagtggtaatgaaacctgttcacataaggtgcagacttgggggtacccgccactagattccacggtacttaggact

SEQ ID NO: 99251 - DNA, 323 bp, Homo sapiens
ctctagaggatccttacagggagagagaactgatgtaaatgaagccaagcagaggcatgcagaactgagcaatagggagagagagatacagtcccactgccactatttgcacccctggatctagcgggatctgttgtgtgagctggtaaactctcctttatgccaacactactgtgaatgaggttttgtcccttgtgatggaagcaggtctgactgatagagattcccagagctgagctcctcactggatcaaagggtcaaagagcatctgaaggctcttcgtacactgtgttaccagattgtgtggtggaaagattgtacca

SEQ ID NO: 99252 - DNA, 310 bp, Homo sapiens
tgaaatgtggccggtagttccccaggagtaaacaatgtggtggtgcccacgggggaagagcagcttaattatgcacccagccccgcatacaaaacgctccctccatggttagaatttgctggggctaagggagtcagggctggttttctccagcagccttggagctaggtggtgtcatttaaatggccctcaaagccctacctggatgtcttcattgtgccacaccagcctttatccaagctcactgggccccacagtgtggctgatagtgagggtctgggggtggggatcgtgaggtgagggacagcaa

SEQ ID NO: 99253 - DNA, 786 bp, Homo sapiens
  misc_feature (786)..(786): n is a, c, g, or t
gtatttaccacaattaaaaaaaattttttttaaaaagggaggcagtaagatcagagttagtgatgatagaagcagaggtcagagagagagcgagcattgaagatgctatactgctggcctcgaagatggaggaagggaatacaagctaaggaatgcaggtaacccctagaggctggaaagggtgggagaacctcctctcctacagcccctgaatgaatgcagcctgccaacacctccattttagcccagtaagacagtttctggatttctaacctccagaactgtgagatactaactttgggttaagtcgccaagtttttggtaatctgttagagcagtggtaagaaactattactaaggactattcagttcagagaggttaggaccttgtgcatggtcacgaagtgactggaactctgattaagagctggagctggccaggcaggatggctcacacctgtaatcccagcactttggaaggccaaggtgggcggatcacttgaggtcaggagttggagaccagcctggccaacatggtgaaaccccgtctctacttaaaaaaaaaaaaaaaaaaaaaaaaaaaaaaacccgggggcccttaaggcgcggggggcgcggacaacaacagggggtcaacagcgacatgggggccacagggcgccaaacacggtggtctccggagaccccagtttttctttggcacaacgcggggaaacacccggcgggatcccccaatatagaggggccgaaataatcgcagatacgccagtgtaacccgggtaaggn

SEQ ID NO: 99254 - DNA, 434 bp, Homo sapiens
  misc_feature (135)..(135): n is a, c, g, or t
tgctagaggtctgtgtcatcccttgaactatagagataatgcagaaaaatgtcagctaatcctttatttctctggactgttctggcccacaggacaaaattctacagtggtgaaacgagagagaacaacagatanatacactacacttcagaccaagctctcaccaaaatggtggctgggaaataactggagacagaaccaccaagattttaagagatcataaactgggtagcttataaccaacagaaatttatttacacagttctggaggccaggaagtccaatatcaaggcaccagcaaattcaatgtctggtgagggccagttccatcttgctgtgtcctcacatggtgggagggatgaacacactctaagcccattcatgagggctctgccctcctgacctaatcacctccccaaagcctcacctctgaa

SEQ ID NO: 99255 - DNA, 770 bp, Homo sapiens
tcctgctcccgtgacgtgccctccctccttccgttccccgtttccccttcactacccagggctggagcctgaacctggcggggccccccgtgaatggaagagcctgggccacgcgaaggtggaccccactcagcctccagccgtgccctccacgccccagacaccgccgtcttcggaggcgactccgcggtcgtgtggacggggtcccatttggactccggggtctgcaggatcggcaggaaggactttgctctctgctgctgggcggggaggggtacgctatctgccgggactccctaaccctttagaaggagcaagtgcgtccaaatggtttgaaagtggacctttattgttttccaggagtaagaagatagaacagttgaccagttttgtttgtaaaacttctttccttgcctcggacttgtgctataaagtgaccagggcgtagtgagtacagttagtaccgcacacgttagcacgctcgaccttaacgatctttttatagagacaataaacctgcagcgtttcatgccacgtctttgtacgcatcggatgtctctccgtgtagttactaggtgaaatcctcttggcgtgcgcaaattaggttaaaaaaatagctgtcaaacctgagacaggagttggaggagtagagggtggcgcttgttaagtgaaacatttaaccaggaatggtattgtgtgccatcctgtattaaacaatgtatggacagagtggaacaacagcaaagcaaaaaataaaaattttttaaaaa

SEQ ID NO: 99256 - DNA, 611 bp, Homo sapiens
  misc_feature (10)..(10): n is a, c, g, or t
  misc_feature (12)..(12): n is a, c, g, or t
  misc_feature (36)..(36): n is a, c, g, or t
  misc_feature (41)..(41): n is a, c, g, or t
gcatgcacgngnagtaagcttgatcttgtagagcgnccggntatactatatgctggagaagacgacagattgatcggcaggaaggactttgctctctgctgctgggcggggaggggtacgctatctgccgggactccctaaccctttagaaggagcaagtgcgtccaaatggtttgaaagtggacctttattgttttccaggagtaagaagatagaacagttgaccagttttgtttgtaaaacttctttccttgcctcggacttgtgctataaagtgaccagggcgtagtgagtacagttagtaccgcacacgttagcacgctcgaccttaacgatctttttatagagacaataaacctgcagcgtttcatgccacgtctttgtacgcatcggatgtctctccgtgtagttactaggtgaaatcctcttggcgtgcgcaaattaggttaaaaaaatagctgtcaaacctgagacaggagttggaggagtagagggtggcgcttgttaagtgaaacatttaaccaggaatggtattgtgtgccatcctgtattaaacaatgtatggacagagtggaacaacagcaaagcaaaaaataaaaattttttaaaaa

SEQ ID NO: 99257 - DNA, 702 bp, Homo sapiens
tgctggggttacaggcgtgagccacgcgcccggccaaggcccggttttagaggcactaagtcttcctccaccctgccctttacactttgaagcctatactgtatatgtcgatagggttagagaatccattccaggctcggggacccagaggcctggctgcagctgggcctggctctcactgcatccctcctggcacaggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 99258 - DNA, 680 bp, Homo sapiens
  misc_feature (627)..(627): n is a, c, g, or t
tcccccgggctgcatgtaattcggcacgagggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctggaaaaaacaaaaaanaaacaactgtggagacaatccctaggactagggacagggctgtgccggcctgg

SEQ ID NO: 99259 - DNA, 632 bp, Homo sapiens
ggccaagtaaaactaataagcgcgctcctataacggtaagcggaagtgccattgggggatggccgaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcggacagagtctcgctgtgtcacccaggctggagtgcagtagcgcaatcttggcttagcgcaagctccgcctcccgggttcacaccattctcctgcctcagcctcccaagtagctgggactacaggcacccgctaccacgcccggctaatttttttgtgtttttagtagtgacggggtttcacggtgttagccaggatggtctcaa

SEQ ID NO: 99260 - DNA, 1629 bp, Homo sapiens
caagtctacaaggcgggggggtgcacagatgaccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 99261 - DNA, 1964 bp, Homo sapiens
ggctggtactgcctcggaatttatgggatccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctggaaaaaaaagagaaaaaaaaaaaaggaaaaaaaaacaaaaaagggggccacaaaagaatacccctgagagggaccacagagatacagggcaaacgcgaggtgtgtaggaacaacgggggccaccaccatgagaggcagcgagtcgacacaaaccggcggagccggcgcgcctgtccacgagcggacgcacgggaaacaaggccgcaggatgccgcgaagaggacaaccaaaccgggggaggccaaggtgaaccacccgcagactagcgccacggacacaagtcggaggcaacgggcaacacgcagctagggacaagcacagggagacaattagaggacaa

SEQ ID NO: 99262 - DNA, 1522 bp, Homo sapiens
ggctggtactgcctcggaatttatgggatccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccccttcctacctccagaataaagaatctcaacctgga

SEQ ID NO: 99263 - DNA, 1435 bp, Homo sapiens
ggtgatctagaggatcccagtgctacctccacaaacaggaaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 99264 - DNA, 1266 bp, Homo sapiens
gaagggccacaggagacgcaggcagtggcccaggagaagctgtctgccctggctggagcgggcaaatggtgcctgcccctttttccttgtgctgcatctctcccctgcaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 99265 - DNA, 645 bp, Homo sapiens
  misc_feature (5)..(5): n is a, c, g, or t
gatanaactcgagctagtaccctcgataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 99266 - DNA, 589 bp, Homo sapiens
tagcaggctggtacaggtccagaagtgtatgatccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 99267 - DNA, 148 bp, Homo sapiens
gccaggtggctctttctgctgctcccttccccggaccacccctctgtttcttctctcccgacctccgttagatgcgctggacccgtggtgtctcagtgtggcctgtggggctggtgggcggcctgcgattcgagggccctcaggtaca

SEQ ID NO: 99268 - DNA, 1626 bp, Homo sapiens
ggctggtactgcctcggaatttatgggatccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 99269 - DNA, 1627 bp, Homo sapiens
  misc_feature (1627)..(1627): n is a, c, g, or t
ggctggtactgcctcggaatttatgggatccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccctggtacctcagaaaggttttttgttcgtttttctgn

SEQ ID NO: 99270 - DNA, 1430 bp, Homo sapiens
ggtgcggagcatgaagtcttaagctggcgcatggtgcatctcttgttacctgcatgcagttgatcggtggactctgctacatgtcggcgacctctctatcatgcgtgctgattgacttccttccctgaggttcagcctgcgttcatgaatcggaaaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 99271 - DNA, 358 bp, Homo sapiens
tcaaaaaattatcttttggttttgtttttttctgttctctatatacctctgttctttattatttccttccttttgctagcgttaggtttagtttattctttctgtagctccataacatgttaagttaggttgttgatttaaaatcttgtaggcatttacagctgttaatttcccccttatcactgtttttgctgcatctaataacttttggcatagtgtgcttcattttcatttgtctcaaagtattttctaatttcccttatgatttcttctttgaccccttggttgtttaagcgtatattagtccatttgcattgctataaaagaatacctgaggctgggtaatttataaagaaaa

SEQ ID NO: 99272 - DNA, 1448 bp, Homo sapiens
aggcagggttcaatggcataggcctgccatccaggcagcagaggctggcatggtgctctgtcccactggcggagtcaggggagatgcgtgctcagccggcccccagcagatccccctttcgcaacccccgcaaagagcagcacgactctgagtagcctaggacaacaacgcttgcacgcaaacaccacacgatacatcatcttgtgcgctgccgctgggctcctggctcagtgcgccatggttcacccatgttgctgcagaaccgactccgctgcacgacagctattgggcatcacagtctcccaacgctccttcccacccgtgcgtgacctatccctgacgcgctccagcactgattcacactccacaagcctctccgccccacggcggcactcatgaacgcatagtacagggacaaagtcacatagggacacaatcttgttcgcacccactaggctacaccacacggtaccaccaagctcctcttccgaacaaattcacttcccctcaatccattcaccccactgccctcctccctaccaccttccacatatttcccttccccacactcaacgcctctccaaatgacatactaaatcgagccatacccccacccctcccactaactaccccaccaccagcaaaaccaccccacgccacacaacacacaacacgtaattccgatacatccacaccctcccacacacttacatcatcaccctcaatcactgccttatctaccgccccatccccccaatcacacacaacacccctatcacacccctacgactgcccatacccatcaaacatcactcttcccctaaccactaccctacgaaacacacaccaatacatcatacaacacaccctaactacccaccacttatccacaatcttacacactactcccaaccatctaacatctctatctacaccacacgtaacccacactacacaacccccccacacataccaccactctcatcactcaaccaaaatcagcctaccccaactacaatccccacaacaatcatactccaaacaaccctataccaccacaccccatcccccaaaccacatacgaaccactcctacccccactccttccatatcaccccccacactcactaccccacccctcccctacacacctcataacaccaaacagcacctatacaaatcaacataactattcaacaccaccacacacaccaataccgaacaaccacataacatatatccaaccacacactacaagcacaacccaacaaccacacacatcaccatacatcacacataccaactcgtctactacttctagacaccaaacaccacactcaactcccacacctcactgctgccctccatactaccccccatacacactcatactaccaccatcaccacacaccaacctcacacacacacctctacatccatcaccagca

SEQ ID NO: 99273 - DNA, 633 bp, Homo sapiens
atttttgtgaaataatactaatgttagtattataattgctgtccccaagtgttaaagatgtactactgtttttataaaagaatgtaaatttagtgtcctttagacacagaataactgattgtttttactccaaagaactttttcagttttgagagtatgcaaaacctggataaaattgaagttttaagataccttgataatatactttttctcaaagcattatagttatgttggcatttttaattaaccagaatattttctattttcataggttatttcaaagttaaagacagaactctcaagcatcattaggattcctcaagattgctaagaaactcccttcgagaaatagccaatgttaattgtactgctaactgaactatgcatatctaactcatctcaaatgactcataatgaggcgctatatatttgctttaaaaattatgcacagaatggtttggtgcagataacttaagctttctcagctgggaatttcagaagatgggggagaacttctacaagggagggcaggtacctgtacatggaaggagctgagatgtctaaagtcacccacatttgtcatttgaaaaagtatatataaataaaagatactattttgaagaagtataaaaa

SEQ ID NO: 99274 - DNA, 643 bp, Homo sapiens
ggaaaatataaaatttgaaaacagcatcagtagacttactgaagacaaaatacttttagaaaattacgtaagaagcatagaaaatgaaagggataccttggaatttgagatgcggcatcttcaacgagaatatttaagtttaagtgataaaatttgtaatcagcataatgacccttcaaaaacaacttatatttcaagaagagagaaattccattttgacaactatactcacgaagatacttctagtcctcagagtaggcctttggcttcggatttgaaaggttatttcaaagttaaagacagaactctcaagcatcattaggattcctcaagattgctaagaaactcccttcgagaaatagccaatgttaattgtactgctaactgaactatgcatatctaactcatctcaaatgactcataatgaggcgctatatatttgctttaaaaattatgcacagaatggtttggtgcagataacttaagctttctcagctgggaatttcagaagatgggggagaacttctacaagggagggcaggtacctgtacatggaaggagctgagatgtctaaagtcacccacatttgtcatttgaaaaagtatatataaataaaagatactattttgaagaagtataaaaa

SEQ ID NO: 99275 - DNA, 240 bp, Homo sapiens
aatcactctcagatagtaaagcatttgcttagccatatgttaagctctgaattcagatgaaggggcatctaaaacaggcagagagcatcaggaagggcttcctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgt

SEQ ID NO: 99276 - DNA, 191 bp, Homo sapiens
atggattttttttttccagtgtttttcagtattttttccagtgttacactggaaaaactgtgcctgcctccccttccacctccttctcctctcccaccttacccttcctaagacagcaaggccaagccctcctctttcctgcccctcctcagcctgctcaacatgaagacaaggatgaagatctctataat

SEQ ID NO: 99277 - DNA, 558 bp, Homo sapiens
gcctctttatggaaaaagtttgtcattccctagtctaaggtttagattctgagcttgtcattttagcctacacccccttaccagtgactagctcaaaacaagtctgtgattccattctgactgttctactgagggaattcccccttcttctcatgtggagctgatgagggtaagttgtattaataggacatatgctcaggttttctgaaaaatacttttatctagaaatgcataggaatatgctagtgcctgaagattgtctcacctgcctccagagctagtgcccacacttactactgagaggcctgaggaaacgcctgcctacccaccaccagaacctgcatacgtcacatggagaactagagatcagcctgccacacacaccaccaaggagcccagtggcgaacctgcccacctggcccagtgctgccactgccagcaaccaaagaagccacatggaggcccagggattggcccacgcagacaggctatcatcagtgcccacaaacactgcccatggtccctagtactgacacacctcgtccacaaccactacca

SEQ ID NO: 99278 - DNA, 337 bp, Homo sapiens
ctgtagcgagagggatctgtcagtaatacgaacctgggcctgtcgtgatccagttggaagccttagtggcttccaggatgctccttatcttccttggagtcctcgtgctgcggcttcatctcctctttccctgggccctgcccccaccctctagattccttcccataccccatctttagctcagagcctttgcctgtgctgcttgttctgcatagaatatccttccctcccctacctcacccaaccctcctgtccccctcacctagcagctcccatctacactcagccaaggtgattttagaatctaggaagcaggccaggcacggtggcttatgcc

SEQ ID NO: 99279 - DNA, 266 bp, Homo sapiens
ggtctcctggaataatgaaacaggaatgggagaatacttaaaaagagaacagctgatctgaaataattgcagcttttattttttcttcctcttgagaagatgaaaatgtcagagaatagtgagcctcatttttctctgcatgcttaggttgcgtcacatgttttagaaagccataactaacctcttgagttttccaaacacaaaccccatcggtgacggcttatgatacccataaatccaagggaggaaatatggatggcacccaa

SEQ ID NO: 99280 - DNA, 828 bp, Homo sapiens
gttacactaccgatccccaggccccttcctggaggtttggggcatcttcccctggaggctcttcggacaagcaaggagagggagcaccacccatgtgctggcgccgtggtcattgttgttggtcttgttacgtctcaaagggtgcttctgaggacagaaggaggaagagaaagagaggtgctcgcttggggctggagagttgcatgggaaacagcagcaactcagagcagagccggccatctcacagccgcgggcctctctcccctttctgggctcctagagttggaagtgagtggggccatgaggtcctggtgagcaagaggaaggaggaggaactggctttgcagaccgtgcaaagccggttcccgggaagcacacacatggcctgcaggaggccttgtcctagcatcacctgcagcttcaagcacagtccactcagcccaaccacagaatgggccccgccagtgggatgtgcgctctgggcaaggctcacatgtcctgtcatcggtcctgtggcctcctccttccctcggcctcccactgtccctccgtgtcaagtctcccaccatctgatgcgccctctggcaaggccagtgagtcaccctactccagacacagaacctgctgctgcctcacaggctcccgccatctgccctcctgcctctgctctcaggagaaggacactcctggaattccacatggatcccaccttctccctggagccctgccatactcctgggcaccgctgatgcgctctcctgctggctgacttggccttgaacacgggtggctcaggcctttcccagggacccttgcttcatgccccag

SEQ ID NO: 99281 - DNA, 564 bp, Homo sapiens
tcaggttgaaaaagtcgcactgaggtgtcctgccagcaaaaccagcagcagtgccagccccctcccaagtgccccccaaaatgcccacccaagtgtcctccaaagtgccgacctcagtgcccagccccatgcccacctccagtctcttcctgctgtggtcccagctctgggggctgctgcggctccagctctgggggctgctgcagctctgggggtggcggctgctgcctgagccaccacaggccccgtctcttccaccggcaccggcaccagagccccgattgttgtgagtgtgaaccttctgggggctctggctgctgccacagctctggggactgctgctgaccagacctcgaacatcacagagcaacccttatggagaaacttgcaaccaggacctgtcccagagtgatgcttctcctgcccctttttctcctttccttgggctgacacaccttgtgaggtgttttgtctgttgtcatggcccaagagcccatcctggatcctgatcttaccttcccactttacctcatacaacaataaagctcttttgcctcttcgtga

SEQ ID NO: 99282 - DNA, 529 bp, Homo sapiens
caataatcatgtgagggaggtgttagtaagcctgttttaaaatgaggaaacagaagctcagaaatattcataatgtgtctgaggaaactggcagagctgagatgggaagccaggcttttgatccaaaacccatgttttttcactgtattagttctgttgtttaatttttctaaattcatgttccttttcatgatgagctttagcattcatcaaaggaaatgtctgtatacgtaaattccctgcactgatagaccaagtgattatttatagcctgttgacatttgctgagttttttgctcacatttacattagcttcacaccctctagagaaggctgggaaatgttttgatggcatgtcagagatttccaaatgtatattcactgattcgttctacaaacacttatcaaatgtttactgtgtacaaggcactgtgcctggggtgaaacatatacaatcttttaggagcagttgcatataacatctgttgcaagagcaaccattcttcaagatctattctgggcagaggtt

SEQ ID NO: 99283 - DNA, 396 bp, Homo sapiens
gctctccaaattttgtaaccactagtatagactaagatataaaaagaacaggacattgtgaactaagcccagtacatttcctggaagttggctgttgttttaaatttcacaggagctttcattatgattagacactcaaaaataggaagacaggcagggcgtggtggctcacgcctataatcccagctctttggggtgcctaggcgggcggatcacttaaggccaggagttcgagaccagcctggccaacatggcaaaaccccatctctgctaaaaataaaaaaattagccagatgtggtggcaacacgcctgtaatcccagctaattgggagacttcaggcaagagaatcacttgaacctgggaggtgtaggttgcagtgagccaagattgtgcc

SEQ ID NO: 99284 - DNA, 270 bp, Homo sapiens
aagagaggctgaagatggaagaggacagaggatggagaaacaattaagaagttatgatcataatttccttcagagatgatgaagacacaaactcattcaacacgaattgagataaacaggaagaaataaaactgagattgaagtagagactgcataatgaccttgagaacagggagtataagagagaaagaaggttagttgcttttaatcaatgaaagataagactttcacctcacttcactgaaatagacttggatgtctacttggata

SEQ ID NO: 99285 - DNA, 303 bp, Homo sapiens
tgttccccttgacttgtctttacaccatcttaatcaatgctgtcttacagcaacaattagtcattcatagcctgtggtttgtgtccatcagtgagtgtgccctgatagacctgaaaagattgggagaccatgcccagcttcccattatttctgtagcctgtcctttgttcccataacagtacagtcatgccttagtatctgtgggggattggttctagaactccctgtggataccaaaatccatggatgctcaagtcccttatataaatggtgtagcatttgcatatgacctgtgcacatcct

SEQ ID NO: 99286 - DNA, 154 bp, Homo sapiens
tgtcagcgcctctggtgtgcagctgtaaggctgttcctgctggtcttcctttcttccctgactggagtttctttcagggaggagtaggaaggtgacttccacctgtctgctagtttagctaccctgaaattatgatgggaggtctgtcctctct

SEQ ID NO: 99287 - DNA, 820 bp, Homo sapiens
  misc_feature (802)..(802): n is a, c, g, or t
  misc_feature (814)..(817): n is a, c, g, or t
gggaggatgtggtgagccgagatcgttccattgcactccagcctgagcagcaagagcgaaactctgtctccagaaaaaaataaaaaaaaggcaacaatctatacgtatattcaaaacatgacattcatcaacaaaagatacgtggaaggatgctcactacaagcactgcttgttaacagccaaaaaaataaatgcctaccatcaatcaggacaggcaaataaaaacctattattcacataatagaaaacaatgtagccatttcaaataaataaaaagatagctttaaatgtactaatatagacatgttgaagcttctctaaaaggaaaataccactagcatatagcatgattctactttcattctttatgtacttctgtaacagcggggatctttttaaaagcgtgaacatacaccgcttttgtaatttaaagattatctattacaaatggggggaggagtgtataagaatggacaaaccctcaaactggtggaaaacccaacaaaatgttacttcttagtaaatattttaaaaaactatatatatataaaaaacacaaaaattgaacattttgtaaacatgtttcaacataccaatatattaaaatacagacaaaaaaagagtaaattaaaaatagaaaaatcttgatgtatcactgattaaataagacttagattctgcctgctcagagaaagtgattcataaactgaaaaatcaaatttaaaaaatgtaagttcgggccaggcgcggtggctgcagtgagctgagattgcgccactgcactccagcctgggcaacaagnaggcttcgtctnnnnctt

SEQ ID NO: 99288 - DNA, 340 bp, Homo sapiens
gcggccgcctactactactaaattcgcggccgcgtcgataaaatacttaggtgtgaaacttctctgcatcttattctcaaatggaccaggaagaagtgcatataaaaatacatgttaaaaaagagaaattatctaatttttttttctgagacatagtcttgctctgtccaggctggacacaacctttttgtccaatcatattttaaaacagctgtccatactttcttgaacctaagcatacaattgaactgtttcccctgcatctgtggatcttcattctgaaggctcccatgtcacgtaaaactatgatcaaataaatttgtttgccttttctcccatt

SEQ ID NO: 99289 - DNA, 631 bp, Homo sapiens
aaataactcaggctggagtacagtgacgtgatctcagcaactaaaacatgaccataattcaaaattaggttacagaatctaagtttatttcataagtattttattttttgatttttgtgttgaaaaaaaaatctgttttttctttttccaaaaacattcattgtacatttaggtagacatttctaaaaagagagacatgtgtcttgggacccccacgtttcattatttagctgtgaatttcttttaatctacccacttcttttaaatcgcaaacaaattacttgcagctttctttagtctctgcagaaaattactcaagtaattgtctttatgatgtctttccttcttatttatataaccactgaaaaaggagattttcattcacttgacaagtatttacccagtgccttccctgggtcaggtattctgttgggtagtaggaaggtacaattatgaaaaaggcagactctaacctgaaggcatctagaggaggagacagacacaattacgtaatcacgaatgcaaatgtagcaactttgataatgcaaacaagtcctacaaagcccagagtaaggcaaacataatcccacctgaggaagctgggactgatgaatagaggaggtgacattaa

SEQ ID NO: 99290 - DNA, 219 bp, Homo sapiens
ataaagtccacatggaaaaataaacaagagaaaaggaaaaacgaggcaaaactgtctggatggtgacgctggttagtcaagggtctttggagtgcggacgaaggttctttcctgcacgttaaaatgggatacaagtttataaagaggctcttgttttatgtggtctctgtcgttatctagtagttaagcagcaaaggcacaatttcaggaccggtcctg

SEQ ID NO: 99291 - DNA, 426 bp, Homo sapiens
atataatataaaccattactcacattctgccactctataaacctcaaagaaaaatatttcaggacacccccacccaaattaatgatctttgctttcctatggcgaaactacccaaatgcaactttaacttagttttgagttaaggtttagctggggtagccacatagatcactaaattctgacagttcggttggtcttaatgaaatatttggaatcaccaatcacacttaagggaatcaataatcttgtgtcgctctataagctccctgggggcaggaactcgactagtatttgaggaactagtatttgagaactaggcaggcaggcagtttgagcccagacccactctgtttgaatttatatcccactgtaccacttaatagctatgtgttcttggtcaagttgcttaaactcttttttcatcta

SEQ ID NO: 99292 - DNA, 279 bp, Homo sapiens
agtatgtatgatgcattatagcaaagcaaaaaatgcaaacttgataaatttggaatttattatattaaattcttagcctgaaagcagttgtatatatgtgtatgcacacacacacacacacacacacacacacacactctctctctctctctctctcattgatttatctgctgtaatttgtagaaataaagtgaaatagttgactactgactttttatactcctaacattctgtgccaaaaatcatgattatatttttgttgtggagcagaggtttttg

SEQ ID NO: 99293 - DNA, 136 bp, Homo sapiens
tgattccacagaccttcatgttggggttggggaagaattgggttcaaagagctgacccaaatcaggctcacctcccattacaaacattcgcacacagacccaagatctgacataaatagttaacacaccgccatga

SEQ ID NO: 99294 - DNA, 489 bp, Homo sapiens
caagggctgaggagtgcaggtgcgcggtgcgggacccgggggcagctccgcctcggctctggcacgggatccactaggtgaagccagctgggctcctgagtcaggtggggacttggagaacttttacgtctagttcaaggtttgtaaaggcaccaatcagtacccagtgtctagctaatctggtggggacttggagaacctttatgtctagctaagggattgtagatacaccaatcagcactctgtgtctagctcaaggtttgtaaatacaccaatcagcactctgtgtctagctcaaggtttgtaaacacaccaatcagcaccctgtcaaaacggaccaatcagctctctataaaaacagaccaatcagctctctgtaaaatggaccaatcagcaggatgtgggtggggccagataagggaataaaagcaggctgcccgagcgagcggtggcagtcctttctggtcctctttcgtgttgtggatgctt

SEQ ID NO: 99295 - DNA, 192 bp, Homo sapiens
ccaccttggcctcccaaagtgctgggattatagatgtgagccactgcagccggtggaaacccaaatctgttttggtttgtatttgcccattctctgggttcccttggtcacagctcagctcttatgaagagaggcaaagattagaaccagaatttctagttccaggcaggctgtgctcaaagaatccttccc

SEQ ID NO: 99296 - DNA, 270 bp, Homo sapiens
ccctgtctgtgtgagtcaccaaaggattagcagagggaggattagacaaatgcagctacaatgctcctgctcattgtctgtcatgccactcatgttttctgaaaacaattaggagccatttgctgtctactgatggaacagaaagtcccacttctttaaaagggctactttccccagcatcagagggttctgatgatctggagtcatctcatgattttcctctgataaggcattgtttgttttcccctgctccttcaagtctcatcagta

SEQ ID NO: 99297 - DNA, 322 bp, Homo sapiens
tgtccatctcagctgcaactgtactttgtgtcaaccagtattcaagggaggactctgattggttcagttaatcctttcaagccaagcccatgagttgtgctctgcttggaacaggggtttgcccatccaatcagctgtatccagggctagagggaaagtggaatcccatgcttcagaacctgccctttcgtataacaggagctgagaccataaaatctgccatggatgagaccacactgagtcctccacttcttccaccttggctacccctgagatagcaagaccaatccttcctcttcttcctccttctcagtctacacaa

SEQ ID NO: 99298 - DNA, 785 bp, Homo sapiens
ttaaatcagtcacagtttagccataaatagttcccaccttggtctttattatcatttttaaatgattaaaatttaattttttaatttttaattttacagacaggtcacccaggctggagtgcagtggcatgatcacagcttattgtaaccttgaactcctgggctttaaagcaatcctcccacctcagcctcccaagtagctggaactgtacatgtgccactatgcctggctaattaaacacaattttttttttagagacagagtcttgctatgttgcccaggctggtctcaaattcctgggcctcaaatggttctcctgcctcagcccctaaagtgctggggattacaggcataagccactgcacccagtcaatacaattttatttttaataaacccccagagttccttctgaattctgtcactttgtacttctttgtacactttgtacatcttgctgctgctttgcacatggagccttgtttattcactcattcaacaagtgttgattgaatgcagagactttacatagtctgtattcaatgctatacccacgtgacataaaacagggtctgcactcaatgaacaaataaatcattgtgtaatgtatcagatggagactagtgctatggagagaaataaagcaggataaggaggcttcgaaggctgggtacaccaggggttcctattttatgtaggatggttaggagaaacctcacggagaaggtggcattggagcagagatctgaaggaggtgagggagtgagctgtacagatatgtgggca

SEQ ID NO: 99299 - DNA, 132 bp, Homo sapiens
aaaccacatcccctgtcacgccctattcctggcagcagaagtggcaggtcacctaagctgctggacagaagggctgcgctctgccgcctgccttccccggggctgcagtcaccctgctctgcatgtgggacc

SEQ ID NO: 99300 - DNA, 407 bp, Homo sapiens
catcatgtggaaggagagctaaatattgtgagtgatgcgtaggtgaaaaatgagtgttatctctcccagttccatcccttgagttttaaacacatataatttggtatgatttacatatattatattgctgggcaacattcaattctgctacagataacaagaaaacaaaactcctctgttaagtaagttagtaaactataaggcatattaagcaaaggtaaaataagtatgtcttgtgcatactaaacatagatagaaaggaaagaccaaaatatgcctaacattcataacatgctatatatacatggggtacctcaggcaccttcatacatgacatgtacacgaagcatatgagatactaaaattgtatgaggttgtggatcagttgcacattagtgacatccatc

SEQ ID NO: 99301 - DNA, 627 bp, Homo sapiens
taggggagctggttggaggggtgagggcacttggggagaagagggctggcccctggggtgggggtgtgccctctaggggagcctccatcactccctgcccccagctggctgccctggctggttttccaacaagaaaatataggagaaagccagagtgcgcaggagggggacacaaggctgccccaaccccagaagctatgaggactgcagcccaatgggaaggcgggatgtacgcctggaaccttaggttttggagagaacagagagagtgtccagagctcagctggtagcaacactgaatcaccacgatcctctttactctgcatcaagttcttgatctgcaccgaatcctgccagcctccctaggaggtaggtccccattttacagacaaggaaactgaggttcactgaagaacctggcaatgggcaacgagctgcgatttgaacccagctccaggcgactctaggcttaagtcacttctccactgccacaggctccagatgaatgaggaatttgcactcaccctttcacccccggaattcagtgccgctcctgacacccagtcggtactcaaatccttcctgaacgcatgagtaaatagtaatgttcaccacctcagcccctgc

SEQ ID NO: 99302 - DNA, 347 bp, Homo sapiens
actgttgggccacagtggtagaaacgagcttttaaatgatacggcactctagatcaaagggtttcaaccagttaccttataaccatacttcattaataatcaaaatcatatgacaaaccatagaggtctcatgactgcttaaactactgtttctaataccaaagatgaaatgtttaaaagctatcaacgtgcaatcaacccttaggtgtggcagggtttctgtttttattaaaagtgaagatcacatttggttgtcttcagaagcagtaagtaaataaaatcctaacaaatgggtaatctagatttataaagttgttgtgtggtctatatatagttctactgtaatt

SEQ ID NO: 99303 - DNA, 358 bp, Homo sapiens
aagggaggcagggaggaaactgtgtggaaatttgtgctagacccagcgctccaactttccatctgcttacttatagaatcctgacaatatgacccaatacatatgaggtagaaaattatttacttcattatatagatgaagaaacaggctcagaaaagccagataatatccctgttgccacaaaactaggaactggttgattcagttcaaccagttcattcttaactggattagaattcagatagccttgaaggtcctttagtacttaagaatcctataactatatgaggcttcggcagggctagctacaaaatttgcagaatcctttttcaatatgaaaatatggggtctcttgttc

SEQ ID NO: 99304 - DNA, 694 bp, Homo sapiens
tgagatgagcaaggctggaaaggtcagtcgaggtcaaatcaggcaaggtcctaaaggtcatgatgaggagtcaagcttttcttctaagaacaattgaagatattggattaaatttggcatttcaaaatgctcattttggctgccagatgaaaagtggattggaggcagagagagactcattgggggctgctgccagacatacaggagagatgaggtggtctggcttagagtaatggcagtgggtaagttcaggaatagcttggacatgggagagagtgacaggatggcaccagagttgcaagtttgcatgtgtgggtacccaatggtggtgttttctaaggtgaaggccattggaagaggaccagctttggggaagggtacagtcttgatccttgttgagtatgaggagtttttgagtcaaccagtggaggcatcaagcatacaggtcaggaactggaggaaacagctggactagagatacacatttgggcatatatatatatatatacagtatatatatgcacgctgattttatatatatatatatatataaaataattatggaagtcagtgagattgtccagggcaagaatataatgtcatatgagaggggagtccagactctcaaggaacgcggacatttaaggggagagtagaataggatgggccgtcaaagtctaagtcagagcatcct

SEQ ID NO: 99305 - DNA, 384 bp, Homo sapiens
atttccaattctttttaagttaaagtctacggtatttactcaaacccaagaccacctgttgaatttttctagcagggtttaaaaaagaatctttgatatctatgcttttgactgcagggaaactttagtatcactaggaaaccagagaacaagggaaaacaaagaaaaaaaaatactgcctttagattcaagaaaacatgatcactaaatcagtctctggatgaaatgtgaaatggggagctaatcctaccagcccctgtgggaagagggccctttaaggagtggcgctgagaatgaggcaggctctagatggattgacatttcccttctaaaagaccccagttggtgaatactgattaccccagtcctcggccccagtgatcc

SEQ ID NO: 99306 - DNA, 409 bp, Homo sapiens
ccttctgcttcagcctctcaagtagctgggactataggcgcgcaccctgcaccaggctaatgtggtagctactgagttacttggataacgggtattgatagtaacaatctagtctttgtgaactcagtggttcctttgtgttttccaggataagaggcaggaaggatggcattttagagtatgagtttcaaacgtgatgtaatgcagttgtagtggataccaggacaaaatggggatgaaaactttaccaacttcatagggttattaatcttaattttggctgggcatggtgctcacgcccgtaatcctagcagtttgggaggctgaggtgggtggactgctttaagcccaggagttcaagactggcctgggcaacagagtgaaagaaactctctctatacaaaaaaaa

SEQ ID NO: 99307 - DNA, 252 bp, Homo sapiens
catggaataattatgatttttttccctactgattattaagatcgttttgcatgatttctgcttgcatggtcattgatatggtctgatcctactatgcaaagtgaacactataaggttttatagacactttgggaaatgctagtaagttcctaacaatatgaatgttataaggttaaaagctactcatttatcttaaggattcagatacaaatatgtcagatgatatgtgttatgaagagaaatatgcaaagt

SEQ ID NO: 99308 - DNA, 357 bp, Homo sapiens
ctcgaactcctgacctcgtgatccacccgccttggcctcccaaagtgctaggattacaggcatgagccaccgcacctggccttgttttgttttttaagagatgggacttgctatgttgcccaggctggtcttgaactcctggcctcaagcaatcctcctgcctctgcctccaaaagtgctgggattacaggtgtgagccaccacgcccgaccttcccaaggaatttaatattgaccaagtagtatctttgatatccaccccatatccaaatttccccaattccccctccccctcaatttggccttcacttgtgtttaatccaggactggatcaaggatctcagttgtatttggttcc

SEQ ID NO: 99309 - DNA, 582 bp, Homo sapiens
atggaaacaattctactatccatcatagaaatatattaaagataaatataattagaaagaaattatgaactctatttagttatcttattgttaataatattggaagaatggaaataatggaaacaaagaatggagacaatcctactatccatcatagaaatatattaaggataaatgtaattagaaagaaattatgaactctgtgtagtaatcttagtaatattagcaagaaaacttatttcagttgccagcatctcatctcaagtataagtttacatcttaagtcttttcctaagcacatatattgcaaaaactgcacacaaatactgcctagaattaagagtgagagtgagtcagggaagtggttgggaaaaatagggtagaaatgtgggggtgtggaagattaaaatcagcagaagcaattcttaaacataacaagcaaataacttgaatgggagaagttctccacacaaagagagaagacttaaattttcagaagcaggagggataccaaggatgaagaataaaaagaagcaagaaaccagtccagcaggaggccaccaatgtcctgtgagtgaatat

SEQ ID NO: 99310 - DNA, 347 bp, Homo sapiens
gagacatttgaaatgcagatatttgaaagctgtataatcagtagttaatatggacttacatgcaaatatgtttgacttcttgataacctggcagttagttcagtgttgcagcatgaatcttctccctcttttccttgaatccttggttgtgggtgtttcataaaaagtcttaacctttaagggtgaaaggtgccaaacacagttcttctgccccacaaatgcactgtctgcttggagagaagctatttgattcctgcacagctcctggggccgcctcccatacagtgttctgtgtgagtggaggccccagaaatctgcaccgagttggcccaggagacaggtgctca

SEQ ID NO: 99311 - DNA, 585 bp, Homo sapiens
tggaagcccccgtgcccactgcagtcaccaatgtgactggcttggttttccttcttccctggtcagtttccttagtctccacccctgctccctggtatcaccactgtccacagtaaactacacacacagttccttgtaccaggcttgtcttcccaggggaataagacagcatgtgctgcattaaaatggaaacacctttacttacttttacgtactgttaatcaacagtcactgcccagttcttccaagtggcctttatcatcccttccctgtaacttcctgggtccccgtttgagactcccccaaaggagtaatgtcacgcacagcaggaggctgccagcagggggctccaaccctacaccaacatctgttctgaaggtgcctcagccggactagtgataaatgctttagatttcaccctggcagtgagatacaggtaaagataagtgcctattcaagccctatgttccttttactggcgattcatgtaaaccacactcctaatgaattgaggactaattttttttttgaaacaggatctctctgttgcccaggctggagtgcagtggcacagtcatagctcac

SEQ ID NO: 99312 - DNA, 574 bp, Homo sapiens
aggcgggcagcgcgcaggcctgccatgagggaaagccaggatgccgccggagctcatggctggaaccgcgtcggctccacggccaccaagtggttcaccggggcgcccttcggggtgcagagccacaggtttgacatctctgctgtttatcccaactggaagaagttcagcaccttcactgaggccccatactccacgcgttattctacccaagtgtcccacataggccctgggacttacagctccaaagagacctgcttcagcaagaagaagctgatgaaggaggtggacacaggctgggccaaggcccaggaagccacgcggctgacccagctaccccacttccagtaccaggccatcatgaaagagaagcggctgaaggagcaaaagctgggccccggctcctacaacctcaaagacttcttagaacagctgcgggagaaaccatgtagcacccgggggctgctcagctctggggaggttcgcttccgaggactcactgggaactactatccaggccctggaaattatggggagaagggtaacccatacaccaagctggaggagaatgcct

SEQ ID NO: 99313 - DNA, 188 bp, Homo sapiens
ttcaccttggcttcctgaagtgttgagcctcccaaagtgttgagcacaggcatgagccactgcacctggcctatttattgttaagttctgagttatttatatattctggatactagttgcttatcagatatatgattggtaaatattttctcagtatctacaggttttcatttcactttcttgatggt

SEQ ID NO: 99314 - DNA, 835 bp, Homo sapiens
agacgtcatgctcctattcccctagatcctttagcgtgtaattctaagatcaagggcattctctgatgtagtgtattacaatgatcaaaatccggaaacttaacattgacacaatactattatctgaattactatttatattcaaattttgagagttgttccagtaatatattttacaaggacaccccttcctctccctggaccataatttaatttttaaaactttgacataccttcaattagtgttttctttatgtcagtttttcttttctcttaaaaaaagcttaacagaaatcactgaggttttaaattactgatttctttttaataaaagcctttcaggaagaatgtgtgatcatttaggaaccaattttgacagttgtgtgatctgcatgaaccatcaggttgggagagagtcagaagttagaataggtactgattttgtcacctgattgtggaggagtcacaactttttctgaaccttgatgtgttcactgtaatataggcttaatgatatgtgcttgcctgtctcattgtgtgtataattgaagtttctttggaacttactaacacaaaaaatacagttaggatgctgacttttaggattccaaacctagttctgtcaaatgaccatttctattatgatgaggaagagtgataaagggatttaaggattaagaagccctctttgtcatatatatctttagatgataatgatgtgatacagaactttgtatgcaaaaagagctgagatttaaatttgagaattatctccatgtaagtgatgatagaacttacttaaagtagcaaaatctcacagaacattgtagaatga

SEQ ID NO: 99315 - DNA, 410 bp, Homo sapiens
accgcaccattgcactccagcctggacaacaaaagcaaaactccgtctcaaaaaaaaagaaagaaagaaagaaatacaagaactgaaaaaccaaaataattgccatttaaggtacactggctccagattttgagacctctgtaatgttatgttagatagctgttacacaactctttatgttggataaggactaggaccatattttatatcagattgttactttagaatcatctagtttaatttccatcatttgttactattacaggtattttataaagaaaacacggtaaggactcaataacacatagctgtgatactggttttattacagatttagatctggaagacttgatcaagtgacacatagaaacaagcaatataatggcttagatgtgtcaccctttctgatg

SEQ ID NO: 99316 - DNA, 501 bp, Homo sapiens
ttagttttggggaagttctctttaattttggtataagttggatgtgaacaataaaatacatttatttaattaatggctggtcttgctttgtggcccaggctggagtgcagtggtgccatcatggctgactgacctcctgggctcaggcagttctcctgcattggcctcccaaagtgctgggctcacaggcatgagccaccatgcccagccagaacacattttaaaaagtaacattgtggccaggaggggttgcttacgcctttgatcccagcactttgggaggccggcagatcacttgagcccaggagtttgagaccagcctggacaacatggcgagaccttgtctctacaaaataatacaaaagttagccaggcatggcggtgcgcacctgtagtcccagctacttgggaggctgaggtgggaagtcaaggctgcagtaagctgtgatggtgatcctaccactgcactccatcctgggcaacagatagagacattatctc

SEQ ID NO: 99317 - DNA, 206 bp, Homo sapiens
gctgagcttgggcagggtggctgagagaattgtggctctagctgtgggcagaaattcatggccttgaagaatggctactgtatataccagtgataaatattagtcactctggcagcagaatgagtttcctgtgctgcatttttggcacttccagaaaagggaaagcctttctctctgacagggcacaggagggagaaacaggaatg

SEQ ID NO: 99318 - DNA, 402 bp, Homo sapiens
gttcatcactcttaggagtcattcactgagcatcagtgaaatcatacttatgtttaaaacaggtgattttctttcttattccagcaatactgagacctgcataacctgaaaatctttctacatacacatggcttaaaaatataatattaaacttataactgacctcattgaaaaaatgaaaattcctatgtggcataagaagccaaacaccagatatggatttatgggccaagtgattgacaacagagtgaacctggtcttataggaggctcaagactccagcataggcagaatccttggaaggcctgcccctcagtttaagagtaagaaagaaatacacacacacacacacacacacacacacactctctctctctctctctctctctctcacgcactcac

SEQ ID NO: 99319 - DNA, 651 bp, Homo sapiens
ataggtccccactcacatattaaactaaattgatgttccatacagaactggtcttagattaaaacatctagcaatctgtgttgtaaataactgacttagaaacaaaaaaaaaaaacctcactcttgcagcatagattggctgctgataaaagaaacatcatttgaagaagttgtctaccatggtaaatttgtcccttggaatattactgcaaaatcagaatggattcttaatcaacatgttttaggcactttccactgaaaacagatcatataaaatatcttgaaatgtgctatactcctgtttttagtattattcacacatttactcattagttctttcattccacaaataatgactgcccactatgagtgtactgtgctagtaggttacttattcaaacaaagaagaataagacaaagttgctgcccaaaagtacccgcagatacaggaaagacacagatgtgtaaacagagtaccacacaaggctacatgagaagagcttccatggggttgagaaggacttaacagtcaaccatgtaaatacagtggaccagaaagaagagctgacaggcaggaggagggagcaagagcatgtgcaaaagctcagaagccgccaccgggtaagctgcgtggatttgggtatggggagg

SEQ ID NO: 99320 - DNA, 302 bp, Homo sapiens
caaactcctgacctcataatctgcccacctcagcctcccagagtgctggggttacaggcgtgagccaccgcaccggccgagattttttaaattataaaatttatcgcaacaaatttgaaaacctagaaaaattggataatttcctagcaaaataaaaaggaatccaagaacatctggaaaactcaactatatcagttacttgctgggtgcagtggctcacacctgtaatcctagcactttgggaggccgaggcaggaggatcgtttgagctcagaagttcaacaccagcctgggcaacgtaa

SEQ ID NO: 99321 - DNA, 415 bp, Homo sapiens
ccttgtattgagataagaatttgtgtatagcctttggccaagccaggaaacaaatctgctactctctggcaattgcttccctaccctcccctgcctccgcactcccccttccccagtttatggcctgaaagaaagtttctcttccattaggtttgtcagtcagcaacctggtcagggaagaggagaaagctgttgataaatttgggagctttgccacaaaagcattaaagatgacttcaaatatgccaggccaatattctttagtttttaaatgaagtctgactagctgcagctccctttctggcatcaccatcatgcatatggttaagagaactttgccaagaacaatatctagcagtgaaggggaggtggcaaaatgatcagatatatatgcatataatagagttattgctga

SEQ ID NO: 99322 - DNA, 301 bp, Homo sapiens
atcagatgccccctcagccatggaagaacaggatggcaaacatcaaatggcacgagagcttccagcagcagttgaaatgcaagtccacaagtgcaagcaaagttttgccctttttgtcaaaaatggactataatttggagaacgaatttgaaatacatcataaccaagctgttctaaagactgattttaatattttatgtaatatcacatatgtttttgaaatcagtaaagacacctggaatcataacgctttttcagtggtaaatgtcatattacgtttttagggcattacgtcaatttc

SEQ ID NO: 99323 - DNA, 315 bp, Homo sapiens
ttatttcagagcttcatcacctcttccaagcaccacttgggacctgagtaccccaaacatggctgggtacacctgcacatcatgctactgcccctgcgcaccagcacatccctggctgctgagccgtccaccttgccatcttcactggtcaacagttcttcatgccgtttgaagagctttgcaaaatccctcaccaacttcacaaaccctgagtctttttactatcaccttcataagcccaaacccccacttaggttggtctcatatctttgcattgtgaaaagtactgcaataaacatgcgagtgcaggtatcc

SEQ ID NO: 99324 - DNA, 185 bp, Homo sapiens
tctctgtctgcaatgaccattcagccctgcagacctcagccccctgtgctgtactggggactgtggcaacagtagccacaatctggcttggggcaggcagagcatcccatggggccaggatctcctacggaagatttgtctttgacatcacggatctttggttatttgggctaacaatggacctg

SEQ ID NO: 99325 - DNA, 162 bp, Homo sapiens
ggcctcccaaagtgttgggcttacaggcatgagccactgttcccagccagtgttagctcttaatatttaagtcaatgattcattttacgttaatgtttgtgtatcagtaagaggtgagggtttaagttaatttttgtagatagtttaaggtatggactgaag

SEQ ID NO: 99326 - DNA, 169 bp, Homo sapiens
acactggttatgtttttagggcaaatgaggaacatgttctgctgtattcattcctatatccccagtgcctgtaacagtgcacagcatgtaacaggtgctttacagatatttattggatagatgtgtgggcttcccttaacctaataaacagccactgtatctttcaact

SEQ ID NO: 99327 - DNA, 469 bp, Homo sapiens
gctgggagttctgcaagtaggagctgtctctgaggctgccagagagacacagacgtctgagttccaggggaggtggagactggagctgggagcatacagacttacacccaactgcctctttgaatggctgacaggcatcccagcttactacgcccagaacctaaagtctccttcagccttctgcttctccagggcaacgctctgatgtcaggggaaaagctggggcttccacccacctggactctccttgtcctcttgtagctgtaaccagccatcaggagacagggtcggctctaccttccaagtaggtccagtgcctgaccccttcctgtccctgcactgcctgccctggtcccagcctcacctggcttggattgttgccccctcccccgcagcctgttcttccaagagcctgttcttccccacagcctgttcttcctgttcttgggaaaacacagatgatgtgacc

SEQ ID NO: 99328 - DNA, 500 bp, Homo sapiens
tgtacatctcattgagctcaaggacagagcttcccctctcctcactgtctgcagtgcctggtccaggcaggacctgccatcaagtcaatgctgaaaatgttggccacacaaaaacatctgcaccgtcggaaggaacagaagctccagaacaatgcctgggcttcaagatccaatggaactttgtcagttgaacgccagtcttgaatccaggtcttcttgcttccaaatgtggtcctctgctgtctcatcagcctcttggggcctcacgctgggctccagttcggggtgtgaggagacgccaaatgcttctcagaatggcctatctgggatctcgcccagtgcctttctccctcctcttgctatttttcgtgtcttttctcttccccctctccctgtgtcgggcgtgtttacttgcagcagccagaaagaccaccttccacccgccctctcttcggttcagctgcacctctctactccaataaaccgtttgcattccatct

SEQ ID NO: 99329 - DNA, 484 bp, Homo sapiens
gtgacctgagatgtctgacgctgatgatgtgcgatgacagcacgtagcacgttgtctgtggactggaagacccgggttgcacaggcagtagcgagaagcgaaagctccatcatgcgatcaatcttctgcgcctccccgggcagccttttctattgaattttgctgtgttcctttgaggcactcatcccaggggctttgaaccaggctggaggtgacttgcacattctgcagaccagagcaatgccattccagaccccaaaaggggccctcaacttcctgacccttcttgctgttcctcctgcagcccaaggggtccttcagccagctccagtccggactgaaggatgttgagaaggacatcaaggatctgaagttaggggtcgagcaaggatgttgatatggtgtatgcgtcattcatcggaaggcattcttgatgtccatgaggtaggaaggtctggagagaagggaagaacatcagattatc

SEQ ID NO: 99330 - DNA, 390 bp, Homo sapiens
aagccatccagcaaaatgtcggcgtcttcttcggcccaaggggtccttcagccagctccagttgtggtgggagagctgcagactgctcacggcctgcccggcccctgtgtcgacggcccctccctaaccatccgggcattctttggaggccaggcccctggtgctctcaggattgttttaagactgctgtgacaacctggagatcatcaccagcctcctggggtcccatctgaccccagctgtgatgccgtctgcacggcaccctccatcatccctaacgcagacacccccaactgagcctacagacgaggacacgcctgacgccggccccaggagaacatactgacctaaaagaggaggcagaagtggacgctctcgtctcctgctgtg

SEQ ID NO: 99331 - DNA, 1920 bp, Homo sapiens
ctgctccacttcccgacgccttccacctgaggccctgaggggccagcagttgtccttcagagggagcctgcagaggtgcagagtcaggtgggacccgtcgtcctcccctcgtccttcagcgccctttgcaggagaaggagacttgggaggcagcgatgggcgctggcggcccccggcggggcgagggccccccagacggcggctggggctgggtggtgctgggcgcctgctttgtggtcaccggcttcgcctacggcttccccaaagccgtgagcgtcttcttccgcgcgctcatgcgcgacttcgacgccggctacagcgacacggcctgggtgtcctccatcatgctagccatgctctacggcacgggccccgtgtccagcatcctcgtgacccgctttggctgtcgcccggtgatgctggcgggtgggctgctggcttccgcgggcatgatcctagcttcctttgccacgcgccttctggagctctacctgaccgctggggtgctcacaggcctgggcctggccctcaacttccagccgtcgctcatcatgctggggctgtacttcgagcggcggcggcctctggccaacgggctggcggcggcgggcagccccgtgttcctgtccgcgctgtcgccgctcggccagcagctgctggagcgcttcggctggcgcggcggcttcctgctgctcggcgggctcctgctgcactgctgcgcctgcggggctgtcatgaggccgccgcccgggccgggcccgcgaccgcgcagggacagcgccggcgaccgcgccggggacgctccgggcgaggcggaggctgacggtgcggggctgcagctgcgcgaggcatccccctgggtccggccccgccggcgcctgctggacttggcagtgtgcaccgaccgcgccttcgccgtgtacgccgtcaccaagttcctgatggcgctcgggctcttcgtccccgccatcctgctggtgaactacgccaaggacgcgggcgtgcccgacaccgacgccgccttcctgctgtccatcgtgggcttcgtggacatcgtggcgcgcccggcgtgcggcgccctggcgggcctggcgcgtctgcggccgcacgtcccgtatctgttcagcctggccctgctggccaatgggctcacagacctgagcagcgcacgcgcgcgctcctacggcgccctcgtcgccttctgcgtcgccttcggcctctcctacggcatggtgggcgcgctgcagttcgaggtgctcatggcggctgtgggcgcgccccgcttccccagtgcgctgggcctggtgttgctcgtggaggccgcggctgtgctcatcggaccgccctctgccggccgcctggtggatgcgttgaagaactatgagatcatcttctacctggccggctctgaggtggccctggctggggtcttcatggctgtcgccaccaactgctgcctgcgttgtgctaaagctgccccgtcaggcccaggcactgagggcggagccagtgacactgaggacgctgaggctgaaggggactctgagcccctgcctgttgttgcagaggaacccggcaacctggaggccctggaggtgctcagcgcccggggcgagcccacagaaccagaaatagaggcgaggccgaggctggctgccgagtctgtataactcagggtgctctgggtggggtggcccagtgacttgggaacacagcttcttgtctcagagagcctggtacgctgggaggctggtctggggtggtcactcccggggtccacgtctgggctccagttgatcccctgggtgtctgggaactgcctccctcatctgtgccccctcgtgccgaattctggctcgagggccaatcctatagtgatcgtataaatcgtatcagtcaactgttctgtgtaatgtatcg

SEQ ID NO: 99332 - DNA, 1926 bp, Homo sapiens
ctgctccacttcccgacgccttccacctgaggccctgaggggccagcagttgtccttcagagggagcctgcagaggtgcagagtcaggtgggacccgtcgtcctcccctcgtccttcagcgccctttgcaggagaaggagacttgggaggcagcgatgggcgctggcggcccccggcggggcgagggccccccagacggcggctggggctgggtggtgctgggcgcctgctttgtggtcaccggcttcgcctacggcttccccaaagccgtgagcgtcttcttccgcgcgctcatgcgcgacttcgacgccggctacagcgacacggcctgggtgtcctccatcatgctagccatgctctacggcacgggccccgtgtccagcatcctcgtgacccgctttggctgtcgcccggtgatgctggcgggtgggctgctggcttccgcgggcatgatcctagcttcctttgccacgcgccttctggagctctacctgaccgctggggtgctcacaggcctgggcctggccctcaacttccagccgtcgctcatcatgctggggctgtacttcgagcggcggcggcctctggccaacgggctggcggcggcgggcagccccgtgttcctgtccgcgctgtcgccgctcggccagcagctgctggagcgcttcggctggcgcggcggcttcctgctgctcggcgggctcctgctgcactgctgcgcctgcggggctgtcatgaggccgccgcccgggccgggcccgcgaccgcgcagggacagcgccggcgaccgcgccggggacgctccgggcgaggcggaggctgacggtgcggggctgcagctgcgcgaggcatccccctgggtccggccccgccggcgcctgctggacttggcagtgtgcaccgaccgcgccttcgccgtgtacgccgtcaccaagttcctgatggcgctcgggctcttcgtccccgccatcctgctggtgaactacgccaaggacgcgggcgtgcccgacaccgacgccgccttcctgctgtccatcgtgggcttcgtggacatcgtggcgcgcccggcgtgcggcgccctggcgggcctggcgcgtctgcggccgcacgtcccgtatctgttcagcctggccctgctggccaatgggctcacagacctgagcagcgcacgcgcgcgctcctacggcgccctcgtcgccttctgcgtcgccttcggcctctcctacggcatggtgggcgcgctgcagttcgaggtgctcatggcggctgtgggcgcgccccgcttccccagtgcgctgggcctggtgttgctcgtggaggccgcggctgtgctcatcggaccgccctctgccggccgcctggtggatgcgttgaagaactatgagatcatcttctacctggccggctctgaggtggccctggctggggtcttcatggctgtcgccaccaactgctgcctgcgttgtgctaaagctgccccgtcaggcccaggcactgagggcggagccagtgacactgaggacgctgaggctgaaggggactctgagcccctgcctgttgttgcagaggaacccggcaacctggaggccctggaggtgctcagcgcccggggcgagcccacagaaccagaaatagaggcgaggccgaggctggctgccgagtctgtataactcagggtgctctgggtggggtggcccagtgacttgggaacacagcttcttgtctcagagagcctggtacgctgggaggctggtctggggtggtcactcccggggtccacgtctgggctccagttgatcccctgggtgtctgggaactgcctccctcatctgtgccccaagttccgccaggccctgccccatcgccagtgaagctgctatggagcaacaggaaactggtgataaagctcagctgaacgacaaaaaa

SEQ ID NO: 99333 - DNA, 379 bp, Homo sapiens
gggtctcacacccatgtctgggggtgaatccagttaccaggggaaggaaaaatggaatggagagaacacacaaacaatagacaccttcaaacaccctgggtggaaaatatggatcaatgtggcttattactatagtatgtgtctgactttacttgtggcttattaatatagtatgtgtctgagtttacaagaaaccagggaaagaatttcaataattatacccataaatttagctatccagggagcctgagaagactgccgtgccagctccctcagccattattctcatgagcaacaatccgatatttgagaaagtgaaaacaaataaaaataaagaatgtgtgagatgacattgaataaaaatagatttatgaagata

SEQ ID NO: 99334 - DNA, 426 bp, Homo sapiens
cgtggattcctgcctgagtcaagaattgatttgagaaggccctggcttggtttctctttttctgtggctatacctgtctgcctgtggatgattccactggacctggaagttctgggtctggcttatcactggcaggggtagggtctgcagctgccccactttatgtcagcgtaggatggccaaacctcagtgagtacagcggtcttatcatcttgggctttgaacagacacaccttgcatgaccggtgcacactcctggatgtttgtcctttgccttgaccttcctcttgatccctccttaaagggacagttaaatccacttgctcagcttgctctgtgcagattagaagtgggctgggggaggatggacagctgcagattgaaatcctttccgagtcatctgaacagtagggacaaaggagatac

SEQ ID NO: 99335 - DNA, 372 bp, Homo sapiens
atggtggtgggtgcctgtagtcccagctacttgggaggctgaggcaggagaatggcatgaacctgggaggcagagcttgcagtgagctgagatcgcaccaatgcactccagcctgggcgacagagtgagactccctctcaaaaaaagaaaagaaagaaagaaaatgtcttcatttacttgatagccaagtaggctcttcacccaagttaggcatctcacaggaatataaaagatggccaggcgcagaggctcatgcctgtaatcccagcactttgggacaccaaagcggggagattgcttgaggccaggcatttgagaccagactgagcaaaagagcaagaccctatctctacaaaaagaaaaataaaaaat

SEQ ID NO: 99336 - DNA, 1717 bp, Homo sapiens
  misc_feature (1028)..(1028): n is a, c, g, or t
gaggttggtgcaaactgggaccctctgggcacctctcagggacacagactgtccagctggttacggaagcacatctcccacctgatttattcctaaataggagcgaggagggggacaatctttcccttcacccccacatcttcctttcctcttccctacctccctgtattaatactgagaaaccacacctgaacaatgaaatgactaggaactacggtttctggttgtgttcccaagtgggaatatgggctgttcacgacctcggaatgtagaatgccctcattatttattcagtagacatccaataaatgcggatcaacagcttgcctatctttgatagtttttggcagtgtgtgctggttttaatctttgtacttgtcccataagtgaccccatgactagagagtgggctcttccatcttgtaagagccttctgttcacgttctgttctttttatgagaaggaagttccagtgcatatcccaacataaagagaaacgttgaatacgtactgtttttctcttatatatatgctcaaaataacgactgtagtaaacagtcgtcatgattataggatgaattacgcagccattcatagatttttgtagttgtcatttacaagtggactatgcaatagttcataggcttatgaatacataatctaacaatattagctgggtgcagtggctcacacctgaaatcccagcacttagcgaggccaaggtagcttgattgctagagcccaggagttcaagactagcccgggcaaagggcaaaaccccatctctacaaaaactacaaaaagaaattagccgggcatggtggtgcttcccggtagtcccagctacttgggaggcaaaggtgggaaggtcacctgagcctgggggtgtcaaggctgcagtgagctgtgattgcaccactgcacccgagcctgggcgacagagtgagaccctgtctcaaaaacaaacaaacaatattatacttgtagtatttaaaaaacataattatctggtattcccatagctaatngaatgaaaggggagactttatctccctagacaggaagcacggtacctcctacactctcttctccccacatcaactggataggtgtgtgaacgcatttcaaagtcaagtatggttagtaattacttgatctttttccagccccttcagataagctgaattgaacacccaaaagtgatagtaacatcattttcctttgcaattacaaagaccattaacccaacagaatctccatgctttacctgtttgtgatgtttttgttccattttattaagtctgactcctgataaatgaatcactacacaattaattttttctcattctttagattcatacacacagacacatatatcaagcaaactataaattgctaaaatgacaggccagcagtgactacttgttatcacgtgtgtaacatctcttgagggctgctttgtaattcatttgtatggtgttgttgtaccagtgtaactgctaagtggtttctctggttccatgtgcatttgtacatgaagttgtgcaatctccacataccagcagtttcaaagaatgacagtttgcatgaggccatcttaatagcaggtagcatgtaaccaacccatctgaattaagccaccattgcagaataaaacatttgacactaagccaggtatttcagtggatgagttgtattttggatttccaaaaaaaaa

SEQ ID NO: 99337 - DNA, 377 bp, Homo sapiens
agccaagtcatgccacattcatgacccagagaaaccaagataatcaatgactgttgtcctttttagccaccaagttcagaggtgacttgttacacaaaagcagagaacaaatgtgccagctgccaggggtgtcgacggctcatagctgggtccctctggaaatggctgccgtgtcaccccatgtaatgccttctcctgggagcagctgcatggaaggactggtcctcatgtttccattcaggacacccacagagggtctctcttctttgtgggtgaggcctcaacagtgaaacagctgaggcctctgctgcaaccgcattgcagcccagtggctccccctgcccaggcccactttccacacccctgcaggtgttgct

SEQ ID NO: 99338 - DNA, 1588 bp, Homo sapiens
ggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99339 - DNA, 1523 bp, Homo sapiens
gctgtacggtccggaatttgggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99340 - DNA, 1892 bp, Homo sapiens
ggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactccaaaaaagaagaaaagaaaaacaaacacgaacaagcgagacacaggagcatgagcagcatggaagagcacaggacgaacagccaggaggggggcgcgctacctaccgaacccgacggcgagccacacaagccgacccgcagttgatgaaccagcgcgccgaagaggacaggaaaaacgagcacgcgccctcaactgcgcagaaagccagcgtgctgggaacaccccacgggggcaaaggggacccacacgatagaggcgataagcgcggtgaggcacaccttgcgggcggcgataataccggactc

SEQ ID NO: 99341 - DNA, 1335 bp, Homo sapiens
ggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccaaggccctgtgccgcccgcctcgcccccctgctctgtggattcctttgggaagggctccctgggcaggacaataaagagttttgactcca

SEQ ID NO: 99342 - DNA, 1676 bp, Homo sapiens
gctgtacggtccggaatttgggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagacaggccgggagggcagtgtggccagaaggattcttaagtaactgacccagccctttgcccccacccctggggtaccgagacatgggtagggattagaggcaagagtggagagtcagaccatccaggaaccacatctctggaccttcagaaggaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99343 - DNA, 1598 bp, Homo sapiens
gctgtacggtccggaatttgggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtgtcacctccaggaagccttctcacaccccatcttagtccgttctggctgccataacaaaatctcatcaattgggtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99344 - DNA, 1764 bp, Homo sapiens
gctgtacggtccggaatttgggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagacaggccgggagggcagtgtggccagaaggattcttaagtaactgacccagccctttgcccccacccctggggtaccgagacatgggtagggattagaggcaagagtggagagtcagaccatccaggaaccacatctctggaccttcagaaggaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcaggtcccttcctaggcagagagattgagtgagtcgcccatggtcgccacagcatggacacagcagagcccagactcgtgagccagcatagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99345 - DNA, 1322 bp, Homo sapiens
atagatggagccagtgaggcctagaaatggggagcatgtttcctgttcccaaccagcgaggtgtcagtaaatcaccaggagcgcggagcagcccctgcccgggaccatagctggtgatcccccatagtgggcaaccatgcccagcctgcttccttgattggccaagtttggggtgagggggtggttgggttttccttagggatggcagccctattggggtctgtgggtgctcagggctgcgggccgcatgcctgctcaccaggccctgcccacctatgctcgctcctttctctctgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99346 - DNA, 898 bp, Homo sapiens
ggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcaggtgagctgccctcctgcctgcccacccacacactgcccagaggctgctctcccaaggatcctagaaagaccattcctagcgtccttcagtcagccaggacagttggaacagatgccagttggagccgtggtggttctagagtgacgagctgagggcctgatggagagggaggtggctgtgctgaagtccagctccacctgggccccaaatgcagctctggctcttgcctgctgtgagaccatgggcaactgccttggtctctcttagccacagctgtctctggtgaaatgcaggcaatgattccggctcctcagggaggcttctacggatcc

SEQ ID NO: 99347 - DNA, 396 bp, Homo sapiens
gctgtacggtccggaatttgggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaaactcactctcctgccctttgggaacaaatgaggcatggaaggtagaagagaggcattgtttggagctctgctggaaagttctggttggagagaataaaaaccgttcaaccttctgggagctat

SEQ ID NO: 99348 - DNA, 1792 bp, Homo sapiens
  misc_feature (1607)..(1607): n is a, c, g, or t
  misc_feature (1610)..(1610): n is a, c, g, or t
  misc_feature (1613)..(1613): n is a, c, g, or t
  misc_feature (1615)..(1615): n is a, c, g, or t
ggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactccaaaaaaaaaaaacaaaaaanaanaananaaaaaaaaaaaaaaaaaaaaggggggggggggtaaaaagattcccgggggggggccaaaattaaggcaccaccaagttttttttaacaagggggcccataaagggggcgatataaaaaagggagaaggggcggtttaaaaagcgtgtcgggaaaacgcgtccggatcttggagggct

SEQ ID NO: 99349 - DNA, 1462 bp, Homo sapiens
ggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccaacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99350 - DNA, 1286 bp, Homo sapiens
gccaagcaagtgtccagagcccttctctccccccaggtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99351 - DNA, 1676 bp, Homo sapiens
ggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcaggtcccttcctaggcagagagattgagtgagtcgcccatggtcgccacagcatggacacagcagagcccagactcgtgagccagcatagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 99352 - DNA, 801 bp, Homo sapiens
ggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcaggtcccttcctaggcagagagattgagtgagtcgcccatggtcgccacagcatggacacagcagagcccagactcgtgagccagcataggttagtgctgatctggccgcctctccaagctttcctcttagccacgttcatcattaagaggttctgaaaagaagacttttagggatatttttaagtactgcatggcttttagaagtcccctgagaataactggtcacacagaggttg

SEQ ID NO: 99353 - DNA, 415 bp, Homo sapiens
acatccccatggggagtaaagagtggatagcggaggccagtttggagcttggcccctatgcaaacactgggcacacaggcagttaagaaagaactaaacattgtgtcctacgtccctggcactggggggctctgttagtagctacccaggcaggaatccccaattctcaagctttggagaagttaggatgtagaggctaaatcatactcaattcagaaaaacactggtagggatacactgacctagttcaatagctacagtagaggggtaggaaaggttgacagtcagatcacataggacaaaaaccagaatcaaattacaaggctcaattaggcaacaaagacatattttgtagatcacacattaacagtaagtaaagttctatagactggagtttccagccccataccctccc

SEQ ID NO: 99354 - DNA, 695 bp, Homo sapiens
ttttttgcccttactactcttcagcaatttccctcttctcaaatatttatattacccttttatctgtaggattatataccaagaaagcaaaacaaaacagagcagccacgggctcgaaccgaatccccgccgtccttagaaacggatttttttttgttttgttttgttttctggcagagtctcgatcaccaccctacttccacccccactaaggttcttgctcaatctccctagaaaacctgaattgtttcatccctttcagtcagccccctacgtggtctgaaacaaaatgaaagcacaagccacggagtttaagaaggcagcctgaaggcggggggctgaagaggggtcggggcgctgcagagtcagccaagtagccaaggaagggccccctccgcgtcgcgacggccctcgccccccgcccggcgcgcgcgcgcacaaatacacacacacagtcactcacacactcactcacactcacgccgcgctccgacaccgcctcacctctcgctccgcccgtccggcccccttccctgccccctgcgggaccggcctgcgcgcagcactggaaccacgtaggaggaggcggcggcgcccccgggagtggcagagtctccggcccggcccagagtgaacgagcagtggggctccagggcgcatcccaatccccgcagcgcctcctccgcggcggccgc

SEQ ID NO: 99355 - DNA, 259 bp, Homo sapiens
tgtttgtacctaatcagtcaggctatggctttatcaatttctgatcttcaaattcaccttttagcttccttcattttttctactctttttctgtcttatgctttactagtttctgctgtgattttttcaaaatttttctctctttctaaacattgacctccatttcttctttttttttattttcttaaatggaaaacaaaatattgatttgagacacttcttgtctctaatttttcattctattttcctttggtccaag

SEQ ID NO: 99356 - DNA, 437 bp, Homo sapiens
cataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattatt

SEQ ID NO: 99357 - DNA, 325 bp, Homo sapiens
taatgaaagagacacaaaaatagtcaatagaagacagacaaatattcaagtatttgtttctttctttccccgcttcaaatccttggttccaagtcaggcagggagaagagtatgcaaattcatgggtagcagaagttttaaattacctatcaagccttccatgactataaaagcgacaccaacctttccccaagtttcatctggatattttatcaggaatgacagagtggggaggttaaaaaacagtattgttttctacccttaaagtgttataggttttactggctggggataataaatagggaaacactgagggagatagaag

SEQ ID NO: 99358 - DNA, 384 bp, Homo sapiens
tcggcctcccaaagtactgggattacagacgtgagccaccgtgcacggctagtgattaatttcttataggccaagttctacatttcactttcctcaaaaaaaccttttctgattgtggcaggcagggcaatgggaacaaatacgtccgtgtcaaaatccctagtacctgtaaatatgtgaccttttattgaaaatgagactttgcagatgtgagtgagttaaaaatcttagcataagattatcctggatgatgaggttgggcccaatataatcacatgagtcctttaagtgtaaaaaagtgaggcagaagacagagaatcagagtaagatagggtgagaaagactggatcagccattgctggctttgaaggtggaagggggcct

SEQ ID NO: 99359 - DNA, 221 bp, Homo sapiens
ctccccaaaccctcttccccactggctggtgcctgctcacaaaaagccctttcagaatcttcctactgccccaacacactcaagaggcagcttccagggtccacagtccaaagtgatttgcatgcgatttgttccagcaaatgcctgagaagctatttaatatctgaggaatagattaggacccagggtcatggaatgtaaatattctaaatataaatact

SEQ ID NO: 99360 - DNA, 467 bp, Homo sapiens
acgctgtatacgacatcgctaacgaggacaccctacaagccgtcgctaacaaggacactgtacacaacatcgctaatgagggcaccatacaagacatcaccaatgagggcgctttatacgacattgctaatgataccgacaaggcacgctaacgcggacactgtacacgacatcgctaatgaggacaccgtataagacatcgctagtaactatcgcaagaacaaaaaaccaaacactgcatattctcactcataggtgggaattgaacaatgagatcacatggacacaggaaggggaatatcacactctggggactgttgtggggtgggggggggagggatagcatcgggagatatacctaatgctagatgacgagttagtgcgtgcagcacaccagcatggcacatgtatacatatgtaactagcctgcacaatgtgcacatgtaccctaaaacttaaagtataat

SEQ ID NO: 99361 - DNA, 298 bp, Homo sapiens
gacatcgtgtcactgcactccagcctggcgacagagcgagactccatctcaaaaacaaaaaacaaaacaaaaaaacaaaaaactagatgatactgtctgtctcctttgataactatgcaaactgcaaaagctcccagaagcatagggtagaataaaggctgaaccaaaaagaaaccaggccatgattaagtattttaagctttcataaaaagtagaaatggggtcgggcatggtggctcacgcctgtaatcccagcactttgggaggccgaggtgggtggatcgcctgaggtcagcag

SEQ ID NO: 99362 - DNA, 527 bp, Homo sapiens
tacctggatcatggcagcagcctccttgctggtcttccttcctcagtcctctcctcccttcaccatcccttgagagaacagacctgcagcccaggcatcctcagcgcctcttttcagataaccacattcctatttaaaacagaaccagcccatgcccactctcagtccacgaggtccaggtgtagatggccctatacgccaccctttcaggagagacgtgaacctggtctagcctgtctgaaaccagaggctcaattctaggacactacctgggtttctgagaattggatgtaggcctggagcttctagccatcagcttagtgctggagaaaggcacctccctgagaaaggagctggcacagagatggtaagaagagacccataaatcgtgactttgccagagcccctggatccagcaggctgaaagccaggctatctttggtcttcagtaacttgagccaataaattcttttttgatccaactactttgaattgggtttttgtcacgtgcagctgaaacggtcatg

SEQ ID NO: 99363 - DNA, 392 bp, Homo sapiens
tttagatggagttttgctcttgttgcccaggctggaacacaatggcacgatctcagctcaccgcaacctccacctccccggttcaagcgattctcctggctgagcctcccaaattgctgggattacaggcgcccaccaccaggcccggctaattttttgtatttttagtagagacggggttttgccacattggacaggctggtctcaaactcctgacctcaggtgatccacttgcctcggcctcccaaagtgctgggattactggcatgagccaccgcgcccggccaggaataagtattttagaactggttttccaatctttcatttcataatgttcataaactaccttctgaattgtatctacaattaaaaatcacaatctccattaaccg

SEQ ID NO: 99364 - DNA, 380 bp, Homo sapiens
ttttttttttttgagatggagtctggctctgttgcccaggctggagtgccgtggtgcaatcttggctcactgcaaactccgccgcctgggttcacaccattgtcctgcctcagcctcccaagtagcttggtctacaggtacccgccaccatgcccggctaattttttgtatttttagtagagacggggtttcgctgtgttagccaggatggtctccatctcctgatctggtgagctgcttgcctcggcctcccaaagtgctgggattataggcgtgagccaccacgcccagcctccatcaaaacaatcttaattataaacgactagctatgggtagactacaatattatatatgcactgggaaaaaaattattacatatg

SEQ ID NO: 99365 - DNA, 378 bp, Homo sapiens
gatgcccggagctattatgactatataaaagctatgggccaggcttcaggaggaataattggtgcaacagtagtacatccctggagatttagacagagattgagactattttagctaaaacacaaatgaaatattaatctttggctcatgactggcctagtcatttccaaacatgtctactggctgtatgcagtggattcttttgaaatacaaattcctctgtgacttttcccactgcccacaagatgaagtccacatcctcgagaacccatgcaaggccctccatggctggcttcagtttgttctgtcaagctgcctttcgttgcatggtgcttcagccaaacaagtcgattagcttattcaggtcctcaaaacact

SEQ ID NO: 99366 - DNA, 435 bp, Homo sapiens
aaaggcagtgtcacttagcagagcgccttcacccagaacaccagaggctgaatgtaacctctttatttctccaacttttcaccagttaaagggaaaaagtgaattaaagtgaaaaataaaagattagttgaagtaccttttcaaagactatattgcaaaaccaagtaatagcattagagatgatgaaattgtgtacctgcaggtatattggacagaaaggaaaaaatgcaatttgactgtgctttgcttttctgaataatctgccacctttttttaaatttgaagataagtctcaaaaaagtaatcagtgtttacattttagagcaaattttgtatttaaggtttatccagggttttattttatgctgtttcaggtatttaaagattctttgttaattaattgtaagacaaacttcacatgtttgtattaaagag

SEQ ID NO: 99367 - DNA, 339 bp, Homo sapiens
cccaagtccaacctctcaggctgcagccataaggacccaggatggctgacatcacttcacatttatcgggtgcccactgcataccaactacacactgggatcccagcagagaacagagtagacaagaaatttcactccatggagccaatattctggacatggtggagatgagggagtggcaaagactctatatcttaattttttttcagaaatggggtcttgctatgttgcccaggctggtcttgaactcctgggctcaagtgatctgcccaacttgcctctcaaagtgctgggattacaggcatgagccacctgatctggccctgcattttgataatt

SEQ ID NO: 99368 - DNA, 676 bp, Homo sapiens
cgcctcccaggctcaagtgattcttccacctcagcctcccaagtagttgggactacaggcttgtgccaccacacctggctaatttttgtatttttagtagagatggggtttcctggcctcaagtgatccacctgcctcggcctcccaaagtgctgggattacaggcatgagtcactgcacctgagctatagcaagcttttcaagacatgagtcttcatcctcaaaaaaaaaaaagaaatgccattggtcagtttcagcctatgggcttcccttttcttttgggaagatgaagctgtcactcagattaatcacccaaataaccactgggggcccagtgactaaagtgataatctcacagccacctcttgttaagtaagagagtctgacatggaagacctttacctaaacacagtaagaagtagcagttatgaagactttataaagccttgccctacagtaatgtcacctaaaccttccccttttccagtatccatttaaagaaagccccgtctaagctgcccatgtggctgtggcttacgtgggcaagcagggaaagcaacagacagcaagctgaattcttagcaggaaactggcccttcgaagtgcccccttccccttcaaattgcccccttcccctctcttgttttctacaacacccaggtaatccctaattcct

SEQ ID NO: 99369 - DNA, 5512 bp, Homo sapiens
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtgggtacgtgagtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaatccacttgcctcttgtcttaatggggagtgtctttggtcttgcgggggagatgtaaagggtggtagtggatggaatgacaaaatatcaagccctccaggttatgacaaaataggagcccagaaggggactccctgggtgggtgaaggagagctgctgcccctttgtgcccatgcccccttcacagctcaccctgggctgccttgcttggatgccctgccatgc

SEQ ID NO: 99370 - DNA, 4800 bp, Homo sapiens
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtgggtacgtgagtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaatccacttgcctcttgtcttaatggggagtgtctttggtcttgcgggggagatgtaaagggtggtagtggatggaatgacaaaatatcaagccctccaggttatgacaaaataggagcccagaaggggactccctgggtgggtgaaggagagctgctgcccctttgtgcccatgcccccttcacagctcaccctgggctgccttgcttggatgccctgccatgc

SEQ ID NO: 99371 - DNA, 5781 bp, Homo sapiens
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagccaagcgcaaaatgtggaaactaaaatcctttggtagtttaagaaatatttataaagcaggtaacaagtggggagccgggaggggcgctcagctggggtgcagaagggtgggggtgcccccgccttcccctgcatgtgctcgggcttcctgctgccccccaccctctgctttccctacccccactgccccactcccaggggctcgggatggacatcagggaggacggtcttgggaaaggcagcccctgcttgaactctgtcccttaatgaccccatcccatcccccactcagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaaggtaagagtttgaggtggagtggaggactggccgcaggaactgaccctggtgctgacggccattggcaacgacacggccgaagtcgtgtgagaggagagcagaggtgtctgagaaggaggtggggcttggaggcagagtcagtgccaacccaaaccctctctgcagctgcgcacagacagccaaagcgaggccgtggccatccaggcgatccggaacgccaaggggaattcaatctgcgtggactgcggggcccccagtgagtgccaggaggcagcggaggggctagggagtgtagtgaatgccggggtgcctgtgctgcccggctgggagccgacctctacgctccttccgcagaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcggtaagcgtgagggaacagagcggggggagggttgctgagggtgtgcgaacctgagacggtcccgtgggtaggggcagaagtcctggctgggggtccctagagccttttccgttgatccctggtcttgcagggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtgggtacgtgagctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaatccacttgcctcttgtcttaatggggagtgtctttggtcttgcgggggagatgtaaagggtggtagtggatggaatgacaaaatatcaagccctccaggttatgacaaaataggagcccagaaggggactccctgggtgggtgaaggagagctgctgcccctttgtgcccatgcccccttcacagctcaccctgggctgccttgcttggatgccctgccatgc

SEQ ID NO: 99372 - DNA, 5955 bp, Homo sapiens
agcttcgacctctggtggggtcggggctggggctggagcccgagggaagttgtcccctcggaaaggcaagagtaagaccttggacaacagtgacttgcatccgggaccgcctgccggctctcctcctccgctaaccctcccaccaactccgagtccagccactgctgtcaccgctgcttccgcgcagccccccgggcctgcacctccaatcactctggagcctccagctccggggctgaaacggggccgggaggggggccgagcatccactcgtgaccgcaagatgctcaagtttatcagcggcatcttcaccaagagcacaggagggcctcctggctccgggccccttcccggaccccccagcctgtcttctggcagcgggtccagggagctgctgggcgccgagctccgcgcttcccctaaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagccaagcgcaaaatgtggaaactaaaatcctttggtagtttaagaaatatttataaagcaggtaacaagtggggagccgggaggggcgctcagctggggtgcagaagggtgggggtgcccccgccttcccctgcatgtgctcgggcttcctgctgccccccaccctctgctttccctacccccactgccccactcccaggggctcgggatggacatcagggaggacggtcttgggaaaggcagcccctgcttgaactctgtcccttaatgaccccatcccatcccccactcagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaaggtaagagtttgaggtggagtggaggactggccgcaggaactgaccctggtgctgacggccattggcaacgacacggccgaagtcgtgtgagaggagagcagaggtgtctgagaaggaggtggggcttggaggcagagtcagtgccaacccaaaccctctctgcagctgcgcacagacagccaaagcgaggccgtggccatccaggcgatccggaacgccaaggggaattcaatctgcgtggactgcggggcccccagtgagtgccaggaggcagcggaggggctagggagtgtagtgaatgccggggtgcctgtgctgcccggctgggagccgacctctacgctccttccgcagaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcggtaagcgtgagggaacagagcggggggagggttgctgagggtgtgcgaacctgagacggtcccgtgggtaggggcagaagtcctggctgggggtccctagagccttttccgttgatccctggtcttgcagggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtgggtacgtgagctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaatccacttgcctcttgtcttaatggggagtgtctttggtcttgcgggggagatgtaaagggtggtagtggatggaatgacaaaatatcaagccctccaggttatgacaaaataggagcccagaaggggactccctgggtgggtgaaggagagctgctgcccctttgtgcccatgcccccttcacagctcaccctgggctgccttgcttggatgccctgccatgc

SEQ ID NO: 99373 - DNA, 5489 bp, Homo sapiens
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaaggtaagagtttgaggtggagtggaggactggccgcaggaactgaccctggtgctgacggccattggcaacgacacggccgaagtcgtgtgagaggagagcagaggtgtctgagaaggaggtggggcttggaggcagagtcagtgccaacccaaaccctctctgcagctgcgcacagacagccaaagcgaggccgtggccatccaggcgatccggaacgccaaggggaattcaatctgcgtggactgcggggcccccagtgagtgccaggaggcagcggaggggctagggagtgtagtgaatgccggggtgcctgtgctgcccggctgggagccgacctctacgctccttccgcagaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcggtaagcgtgagggaacagagcggggggagggttgctgagggtgtgcgaacctgagacggtcccgtgggtaggggcagaagtcctggctgggggtccctagagccttttccgttgatccctggtcttgcagggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtgggtacgtgagctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaatccacttgcctcttgtcttaatggggagtgtctttggtcttgcgggggagatgtaaagggtggtagtggatggaatgacaaaatatcaagccctccaggttatgacaaaataggagcccagaaggggactccctgggtgggtgaaggagagctgctgcccctttgtgcccatgcccccttcacagctcaccctgggctgccttgcttggatgccctgccatgc

SEQ ID NO: 99374 - DNA, 377 bp, Homo sapiens
aaagtcccgggcaagcggcccccgagggccatctctgcctttggcccctcagccagcattaacgggctcgtcaaggacatgagcactgtccagatgggtgaaggcctgggtgagtaaggtttatgacataggagcagaagaggggccagggctggggaaaaagaggggtaagagggaagagggggctggcactgggcgagtaggaagctgggtgataaagagggaccacataaggaatggggccagaagaaagaggctcactgaggtttcatcttcttccgacagaagccactactcccatgccaagccctagccccagccccagttccctgcagccaccaccagatcagacatccaaacacctgctgaagccagac

SEQ ID NO: 99375 - DNA, 586 bp, Homo sapiens
tcttttcatctttttttttcttcttgattctttttttctcttccgtaggagaggggtgggaagatgggacagctttgtttaagagcaggaactttggagacagatctgattttgaaacctgcccctccactgcacagctaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaatccacttgcctcttgtcttaatggggagtgtctttggtcttgcgggggagatgtaaagggtggtagtggatggaatgacaaaatatcaagccctccaggttatgacaaaataggagcccagaaggggactccctgggtgggtgaaggagagctgctgcccctttgtgcccatgcccccttcacagctcaccctgggctgccttgcttggatgccctgccatgc

SEQ ID NO: 99376 - DNA, 5622 bp, Homo sapiens
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtgggtacgtgagtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcaggtgtgtggtctgggcaaagcgagaagaggggggaggtagcaaagaagattggactagaggacctggccgttcccccttcacctccaagaccctggactctcttatttcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaatccacttgcctcttgtcttaatggggagtgtctttggtcttgcgggggagatgtaaagggtggtagtggatggaatgacaaaatatcaagccctccaggttatgacaaaataggagcccagaaggggactccctgggtgggtgaaggagagctgctgcccctttgtgcccatgcccccttcacagctcaccctgggctgccttgcttggatgccctgccatgc

SEQ ID NO: 99377 - DNA, 5549 bp, Homo sapiens
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagccaagcgcaaaatgtggaaactaaaatcctttggtagtttaagaaatatttataaagcagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaaggtaagagtttgaggtggagtggaggactggccgcaggaactgaccctggtgctgacggccattggcaacgacacggccgaagtcgtgtgagaggagagcagaggtgtctgagaaggaggtggggcttggaggcagagtcagtgccaacccaaaccctctctgcagctgcgcacagacagccaaagcgaggccgtggccatccaggcgatccggaacgccaaggggaattcaatctgcgtggactgcggggcccccagtgagtgccaggaggcagcggaggggctagggagtgtagtgaatgccggggtgcctgtgctgcccggctgggagccgacctctacgctccttccgcagaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcggtaagcgtgagggaacagagcggggggagggttgctgagggtgtgcgaacctgagacggtcccgtgggtaggggcagaagtcctggctgggggtccctagagccttttccgttgatccctggtcttgcagggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtgggtacgtgagctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaatccacttgcctcttgtcttaatggggagtgtctttggtcttgcgggggagatgtaaagggtggtagtggatggaatgacaaaatatcaagccctccaggttatgacaaaataggagcccagaaggggactccctgggtgggtgaaggagagctgctgcccctttgtgcccatgcccccttcacagctcaccctgggctgccttgcttggatgccctgccatgc

SEQ ID NO: 99378 - DNA, 1871 bp, Homo sapiens
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacgggtcagtggggatgaccttccatctgctgtcttccacacccaaataggatgagtgtgggaaatgaatatggggtgaaggcttggaggctggaataaatgcatgagtgaacacatggagccccacacatgaataagttcaatcataccatgtctatcataatggttaagacaagtggactctaacgtcaactgcctgagcttgaatcctggcttgccacatgggcaagttacttgacctctccgtgcctcagtttcctcatctgtaacatggagataatagtttctacctcagagggttgctttgaggtttaaacaaactgagaatattgtctagtacatagtcagccatgtttgacatgtttga

SEQ ID NO: 99379 - DNA, 608 bp, Homo sapiens
gaaatgatgagatgagataaaatgagatgaaatgatgagatgaaatgagatgaaatgatgagatgaaatgatgagatgagatgaaatatgatgagatgaaatgacataatgaatgaaatgatgaaatggaataatggaaatgatgagatgagatgcaatgagttgaaatgagatgaaatgatgaaatgatgagatgaaatgagatgagatgtgatgaaatgatgacatgaaatgatgacataaaatgagatgaaatgagatgtaatgatggaatgagatgagatgaaatgagatgaaatgagataaaatgatgatatgaaatgatgagatgaatgatgagatgaaatgatgagatgaatgatgaaatgatgagatgagatgatgaaatgaaatggtgagatgaactgatgaaatgaaatgaaataatgaaatgaaattgaaataaaattgaaatgagatgagatgaaatgatgagatgatgaaataaaatgatgaaatgagatgtgatgagatgaaatgatgagatgaaatgatgagatgagatgacatgaaataaatgaaataatgaaatcgaaatgagatgagaagatacgagatgagatgaaatg

SEQ ID NO: 99380 - DNA, 238 bp, Homo sapiens
tggtgagaattaaatgaaatgatacatgtccaagttctgatcttttacacagcaagtacacaatgatacttagctaccatcatcatcatcatcagtatttaatgataataaagtgcaatattactatgaagtatgtaacccagtactcagcatgtgctaggttctcagtaaatatttactccttttctcttctctctcccttccacaaataactcgaagatttaactctgataagatg

SEQ ID NO: 99381 - DNA, 1011 bp, Homo sapiens
gaatttcatgtgcaatctatacttttttgtgaagttatttggtatggttatgctgttggttggattataagtgaaatcagtaagaccgactagagtatggttaggaggatagaatctgtggccagaatgctcaaatacatatgctgaccctgccacacagtagctgtgtgtgtattcagacaaattaaattacttctgcctttgtttcctaatctgtaaaatgccaactctgagggttaaatgagaaaataaacataaagcacttttttgggttcttatttctatcttttgtcagattttttagtggaagaaaatatgcaaatataagagactttctgtgaaattccagtcatccaaaatctgagttggaaataatcagtatgaacccatggtttattttctttccaagtgtattttctagctctggcttggaagcaataaccaatctaatgagtgcctctagtgaccagattgtagtctctctgtactttttctgactaaaagggatcaaggatccatgctgataaggctgattatagatgggggcaagaaacatacaagctaaacctagaatatcacgtcataacagaaagcagaaatgctcacaaatattattggagtcacatcaaaagatgaaggagctaacatgaagaagccgttttgctggccaaagatgggacaatttgagcatcaaaaaagattgatacaagcaaaatatgtatgactctgaattaataatgatactgaaggaatgaaatatttgattgtctttgggcaatgtcaggtccctaacatgttattctgaaaaatttgaaataatatctttggactcctttttttttccccctaaaaaaaagaaaaaaagaaaaagaggcttgctctgttgctgaggctggagtgcagtagcatagtcatagcttactgtagcctctcaacttcgtgggcccaagcggttttcccacctcagcctcccaagtagctgggactacaagtatgtaccaccatacccat

SEQ ID NO: 99382 - DNA, 403 bp, Homo sapiens
tcctgacttggctggctccctgctttagggtttttggctcacttgggttaagtgagtgaccactatggagaagtggctctgggttacataacttttctagagctctaaagaatagtttcctggcctatttaatgtctcttctttccctagctgacccctgaaatatttggtttgtaaaccataaaaattgattaaatgccatcaactttatcccctgtagaagtgatctgtttttcaactcccatggcttctgatttgtgtaactctttgaacacccaatattgacttgtattgtgttcgctgtttgcatcattcatagaactggcaaatgctctttatgggcaatagggtctcattaaatgattgctgaataaataacacaaatttttaccattatccctta

SEQ ID NO: 99383 - DNA, 169 bp, Homo sapiens
aggacagcatttgttttttttaacaattttaacgtcttaagatatttattttctttttccaggttgtcatttttcattgtgcatatttcctgtctgagtatagcaatatctgtcttcaaaatgcaattttcatccatcagatctttcatttcttcgtgattatgaaaat

SEQ ID NO: 99384 - DNA, 449 bp, Homo sapiens
acttttgacaggctgacctcactacttggtaacatcaccattaccaccttctgaatctcccactttctaagtctactcttcagtcactgttaagtttcatatataatagatagataaatgattgatagatagctagagatcaaatagtgccaggaactgtgatttaaactgaagatcctctttcatcaggccccacttccttcgcttgctgacctcacttcctacagctctgaattcacttccctttcagaacgacagatctttttctctgagtgcccttcctggaagggcctgctttctgccccagtttcccccccattacccttgaccttaacaccacttcttggcattctcagggtttctggcttatggtgggcttgatgccctatgtgcaagaatgagagaggatcttttgggacagctaactatcagtctctaagttcctctag

SEQ ID NO: 99385 - DNA, 482 bp, Homo sapiens
ttccttggcaccattgatgcccacctagaatgatcttttagagctcaactgttcactggctaaagttctaccttctccaccggactggaatgaaggcagggatcaggtcatgctggtcatattccagcatttagcacagagtgtaacatccagagatgctgaggacacaattctgaaaaaagtagtaacaatgatgacagcagtatcatttactgacagctttataagaacagtcgttttctcacataactctatgaggtggaaggcacaaacctcattttataggcgaggaaacagagcctcagagaagtttagtaatatggtcaggcttgcaaggtgaagcaggcagaggagctaggctttgattccaggcagtcggaccccaaaatcttatgttctacaacattctattccccaaggaaaaaccaagtgctctgaaaatctagtctaaaacagaacataattttcaatacacaaattta

SEQ ID NO: 99386 - DNA, 1167 bp, Homo sapiens
gaatgtgatcatggtcttggtttttaagttctttggagtgaaagtgttactgaattactgtcattccttgattgccttgcagctcattattgcttatctgatttccattggcttcatgctccttttcttccagtacttgcatccattgcgctcactcttcacccataatgtagtagactacctccattgtgtctgctgtcaccagcaccctcggaccagggttgagaactcagagccaccctttgagactgaagcaaggcaaagtgttgtctgattctattttctgggtattttaggaagagttgggagttgccaagagtaaccatgaaattgaacgaaaggatgaggttcatgggtgagatacccatcagtacattttcttgacttttctgttaagcctatcagaagaaagagcaactcccaaataggttttattttcttaagagttaccactatgtttggaaacagggggtatcgactatatagttgaaagggtcagaaataccattcacacccttcttacccaagtcaattggaataacttgtcttcaaacactttaggctctctaaagtgaccttctagctctgctcatttgcttgatgcatttctgagctttcctgggctgagctgaaggcccagaatcccgctagaatatatcctgactgatcagaggatatgacagcttaccagctaagagtacctcccaggaaacagtctgactaatgtggaacctgcaactgtcagtgtggctggggtctttttaattccagtgagaagctctggctgagaagaaaatcaccactattaaaaaagctgctccccaagcagattagctctctgttaggattttactagtggccattcagcaaggacctctctttacagtggcacttcataggcacactctaaggagaaagtgcagagtagaattccttcagggcataagccaaaatgactctttttctcagggacctgcatgggcctccagcttgtctattggaattgttaagtgaagcctctcacttagtgcctcattagcagagatttcctccaacccagcttttctgtgctcttggtattttactacttgatgtggacctcagagaagctgaactgtaattgaaaatgtttccgatgtgtggaagaaatgaagactgctttgtgtc

SEQ ID NO: 99387 - DNA, 1345 bp, Homo sapiens
ttcccggcgtgcccggcggcccccttccgctctccctctcgcgtcctccgcctagcaccgacctcagctaggaacggggacgggtcgctgttcggggaaggggctgggtggagtctcgcgaggtgcgagaactggctgggggcctgcgggattctgggaggcgatgctgggaaggggcggtggctgggctcccccggccacccttaaccccttcggtgctttttgcttcaggacctcctggcgggtgcgggtggggagtgaggatggggagctcgactcgcagttcccacttcgtgcttctcctcgcctaaacggttcttacctacacttctcgtaggggacgagaggcaggactttcccttttggtcacctctaaatgactcactgccacataataatgagacaaaaagaccctcataccagtaaaacggttattccacggctgatggacttagacggttcttcatttcttcctgtgctttcaggccgctgtgtatttgcagagcctgcaccagcagcctagagcgttcttaggaacttggtgatatgttgacgggtcgtgtaaagaacttggactctggggccatactgaccagaatgcacctgagggcgtttttagaggcagtaccctggagagaattcaggccctggagtccagcggacctagactggaatcttggctgagtcactccctggctgtccactcaacctctctgagcctcagttttctgatctgcatttgtcttgtatttcatggcattattggaattaaaattaacatacaattcttgacagattggaagaggatgtgaagggagatcttgacattatcaggtccgtatgatatggcgcctggcatagagcaaatgtttaataaatggtagctgttattaccagctgagaaacaataggcaatatacttagcctctctgagccttagttttagaacctgaaatgaaattcagagcgcccagcacataggttttctgtaactataggttcagtcgttgtccagaaacatttctagagtccgtccggagttggattgatgccagctcttaaaaactatgaaggcaggatcagtggccacatttaaacggtttccctgggtgaggaaacacactctccactccctaatgttaacacgtagcgagagccagtattgataggagaccattatggtgtagcccaaactctaacgccaaggggttcagtgttttctgcttctaatactggtcacagaaaacttgtgagtccggtaagcaaaatcctacaaagggaaaagactgcaagttagaataagacacctcttaaaaatctctctagctttaccctgagagaaagg

SEQ ID NO: 99388 - DNA, 671 bp, Homo sapiens
gcggccgccgactactactactactactactactattaaattcgcggccggtcgacaaaaactcttaactgtaaatgttgtctgtggtaatttagaggcacccctcagcacgtgttttagggagctgaacagtgtcatccattttctatgtactgtggccgcaaggctgacgttttatacacttttgcagatgaacctctttgtgaatgtcatgagcagttatcagtctatcatgcagagtagaaagggcaaagctgaactgtaagggcgtcagcacattatggcaataaaatttttcacagcctcagataaaaaaatactgtacttgacaagtgaatctgttttaaattatttcaaatgctatggaaactgaatttctatttgttcggttctcccattaaaagtgggatgttttccaaaagttggttttcaagtcagttgttataaatttgcaacttcttttttttttttttgagactgagtcttgctctgttgcccaggctggaggtgcagtggcctgattttggctcactgcaacctccacctcccaggttctcccacagttctcctgcctcagcctcctgagtagctgggactacaggtatgcaccaccatgcctggctaatttttgtatttttagtagagacggggtttcaccatgttggccaggc

SEQ ID NO: 99389 - DNA, 337 bp, Homo sapiens
gctacttgaggccaaaggtgagcaccccacgtgctccctgatgttccaggtcctgcctgggctcagaggattaagaagtcaacatctcattctctgcacaccagtattttatacaacacatagtgagaagcttgctgatctaaggacattggtcagattatatgaccatagggtcaatatctattatcatattgtccaccctggctatgatggccacacaggccagcagccatactgctaatcaatatccttggcttctccccattccaactagccggctgataacacagactcagttcagattctacccttggagagagaactatatccatctcct

SEQ ID NO: 99390 - DNA, 638 bp, Homo sapiens
atgtccagtaatttcctggatagaaattttattatctgcaaagaatgatatcacatcacaaggatgtccaggtaatccagttccctgtgcactatattactacacatgccaaaagagttaacactacccttgagcaagaagtgacaccagtttctacaaaatccatcaagattatgtaaatatatgtgtatccaagagaataaaatacctaggaatacagctaacaagggaagtgaaggacctctttaaggagagctacaaaccattgctaaaggaaatcagacaggacacaaacagatggaaaaacattccatgctcatggatggaagaaatatcaaaaaaatggccatactgcccaaaacaatttgtagattcagtgctattcccattaaactaccattgacattcttcaaagaattagaaaaaaactattttaaaaaatcatacagaacgtcaaaaaagctcatatagccaagacaatcctaagcaaagagaagaaagctgaaggcattatattgcctgacttcaaactatactacaaggctacaggaagcaaatcagcatgctactagtacaaaaacaggcacatagaccaatggaaagaatagagaactcagaaataaaaccacacatctcca

SEQ ID NO: 99391 - DNA, 118 bp, Homo sapiens
tggtggggtagcagatggatggcaggcatggggtggttgggggaggtggttctaagccacagccatactcaccaactcttgtgaactgcccagccctgctccttctcccacctcgtct

SEQ ID NO: 99392 - DNA, 255 bp, Homo sapiens
gtgaatgtatcaatgtggattttccctttctcctaaatcggtggtagatagagaggccccaaatcattgctgggctgctgaaacaggaggctttgacttggataaggaggagtgtgtctgtgtgtgtgtgtgtgtgtgtctgtgtgtgtgtgtgtgtctctgtgtgtgtgtgtgtgtgtgtgtgtgttgtgcgtctatatatttgtatttacagaacattttgggttgctcttgactgaaaccacaagaagcata

SEQ ID NO: 99393 - DNA, 766 bp, Homo sapiens
aaccatttatgcttcattaacacaaagtaaatgcttcatatttgtttattatcatgatgacctgcacaataagaaccaaaaccaagccagatagtgtagaattggcctgttcaactggcagtattaataaacagcacctgcaagaacgggtgcagtctagcttacaaaacaggaaaatcattcactgaagaatttgcatatggaatacagatacattgcatggaaagaaagccgacctggagactgacaggcagctgtggtgtgaatgcctcatgatggtgaaagtcaggatggtggatggatgctgcattgctttgttgatgcagttatgaacattattgggcaatatgcatatgcaagtgtggaccacattcagcacatttaccttgtgtaacctacacaggttcagtaaagagatttgtgagaccgtgatattcccccatggtagacccaaatgctcgctttcagctcagttttatcacagagactgaaggaataatatctttagcttttaatagcaggacacatttaggaaattatacatgagttgaagatagagaaattctggaacaggagaggtcatcagtgcatttctgcaagtagaagcttgtttagtcagataatgtggtctcaacagattaaaacatcacttgtgattaaattgattggtataaaactataagtgaaccattctgttcgttccatgtattagatgggaacagccaaattaatttgaaatcaagaaattattaaaataaaattctca

SEQ ID NO: 99394 - DNA, 256 bp, Homo sapiens
ctggagggcctgctgtcctgtgggtagggggtggcacttatccttcagtgtaggaaagtgtctgccctcatttgtagctcatattggaaaggatctgggggaggcttgggcagcagggaatggagaaaatgggtaaaaacaggagtgtgtgtgtctttgggggtggtcaagaccgggaataggataggccttgggtctcagcctattttataaaacctgtttgacctttgaagagactcatctactcactcaccca

SEQ ID NO: 99395 - DNA, 801 bp, Homo sapiens
ggtggacgctgatcgggggagagaactgagcctcggggtctgacgccgtctgctgatctgaagcgttgaactcacggacttctaagtctctcaacaccgtgcgggagcgccaggcccggcgggaccgcgtggcccccctctctccctcccctccttctggagggtcatggacgcagagccgtgtcctcccattgctgaatgtgggggtgactgtgggggccggagagtgggggcagctcattgcagcttgtggcgtagcccccccgccatcttgcagctctggaaatgcgcccctgagccccgggggccgccggctcctctctcctccgctccctgtcggaagagagaagaagacaagagcggcctcggctgggcgagggtccccggtacccagccctcagagcgggaggaacgcagcttcaactcaggccagctctgaagagggcctgggagggcgagtagcccctgctgtggttcgagcggcgtggctgctgtgccgggcgtggccggtgctgacttgcgaccatctccatgtgctggttgcaggcgatgagcatttccagggctgggcctcttgttagcgtggtctctagggtgtcctgtcgagtgtacctccccgtgggctggcgcatcgtgcaggaaatggggacacggcggtcctcactgtgtgtccactgcccctttgcggtacggggtgccgggtggggatcccaccgcctgcccagttctcctcgtcatgaatgcgccgtggttcaacaaacagcgtccggccgtggcaattctgcacaaaaatgggatggt

SEQ ID NO: 99396 - DNA, 797 bp, Homo sapiens
ttcagtatccttcttccaccaggaggaagaagaactgtgtctctgaagtttgggaagtatacgtagacatggagtctggccttgagctttctgtagtagaaaggcccatgtcagcagcccttaaagggacagggtgaggtgtactcgggggaaagatggtagtaaccatactcctcccaattttccgtgatacaccacagtgtaaaagaggaccccagtggtttccacggctacacagaaaattcatggagggtagcagaagaagatgagccatggagctgccaggtggctgccagtccaatcttttaaggttcaatttagggaaaaggactttttctcagtaagccctgataccttgatgtgagaaggccaagaagaagcctatagagatgcccacaagaggagactaaagctgagagaaactgaggcccctggccctagagctttcactgagctccagctgacaaccatcatcaaatcaccagccatgtgactgtgccatgatgggagggaatcacccagtgtccaaatgatctgatgccacatgtaaaagagaagagccttcccctttgagccctgcccagattgctactctgcaccaagtttgttctttactcccagcctaatggatgaaatgaaacttggtgagctcccagagttggacaaccttcagaatgctgagacatactaaatgaaggaagaaagtccttttgtgagttctccaaaactcagacctcccagtgactacagcaaggtcctgttgtttcagtgaaaagctgttcaacttggtgaaccag

SEQ ID NO: 99397 - DNA, 288 bp, Homo sapiens
ttaaaagtgtttaaagtttaagctatctccattgttagaatgttctccattacgtgagttggtaaaattaatcatgggacagactttcattcttgctaagtttgatacatagaactaaatagcccattctgaataatccatgtattttttcttctcttttgaaatacaagtttaaaggttttaatcactattccctcctcattataggacactaatttgttatgattaagaaaacctgtgttcatcattgtaaggaaaatttagctttttagactgcaatgcatagta

SEQ ID NO: 99398 - DNA, 2453 bp, Homo sapiens
taattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtctttttttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgtttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaat

SEQ ID NO: 99399 - DNA, 1838 bp, Homo sapiens
taattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtctttttttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgtttttttttttttaatttgggggttctgtaaggtctttatttcccataagtaaatattgccatgggaggggggtggaggtggcaaggaaggggtgaagtgctagtatcatagcgacaacctgtctttttttgttattcaacagatcatcttgagtgtgggcgcggtcatctgttgttccagcaactcagaaggtttgggctcaaaaatcccatgaccccggaagtcaaaggtagcaatgagtgtttttcacgtccttgcacgccagcttgggtgtctgagggatactctgtctca

SEQ ID NO: 99400 - DNA, 593 bp, Homo sapiens
caaagagaatatcatagatacagagatcagacaatgagaatccagagtcttgttaagtgatagaaggaaaatactaacagaacacatgtaacaggaacaacattttagaggaaacaggacaaaaacttccctaaactcaagatactacaccagaagtgggcagtactcactatgttcaggggaacaaaaagataaaaactaaaaagcatcagactgttttttgtgtgaaggaaatttgtaaggtaggagaattaggtcacttactacagcacaaattgcatgtctatctaaattgacgtttaagtgcaaaagcatggatattactcatgcagttttactggaaaaccatacagatgtttttcaggaatgtacagaatgaatcaaaggaaataactgatcgacaggaaaactgtaggaaatttgtgggctggctgtgaggcagtggctcctattatgtacaattttagtgctaagtactgtgttaatgatggctatcaaacaatatgttaacatctgaaaggaaatatgtatattgagcataataaatattttataaataacaataaatcatttgattttatgctagttcccag

SEQ ID NO: 99401 - DNA, 301 bp, Homo sapiens
ccacacctggcagggaaagaggcctgtgtatccaggggacaaggctaagggatccaaagacacaccgacatgcagagccttcagaatggacaggtcaggaaggctgcagggaggaggtggccttgtcaacaggctaggtttcaatcgactgagatggcgaaaggggaaggacatcccaggcctgccgagagtggggtgggggtgacagaacttgccacagtggagaggctggacagagagtagtgggactcagctgttcatggtggagctgctggtggcaagggaagaggggagaggccct

SEQ ID NO: 99402 - DNA, 1044 bp, Homo sapiens
ggaaagcaggtggtgtaattctgagattgaagtcttgagaaccgggggagtcaatggtgtaactcccaatctagggcttaaggcccaaggaccagggctgctggtgtgcagatgcaaatcctggagttcaaaggattgagaaccaggagctctggtgtctgagggcagtagaagatggatgttccagctcaagaagggaaagtaagaatccgtccttcctccacttttttgttctattcagatgagccctcaatggactgaacgatgctcacccacactgtgagggctggtcttctttattcaatccactgacttaagtgctgatctcttctggaaacaccttcacagacacacccagaaataatgttctaccagccatgggcctgttacttagcccagtcaagttgacacagaaaattagctatcacaacatctgtgtgtgtatatacatatgtatttgcatgtgtgtgtatatatgtgtatatatattcatgtgtgtgtatatgtgtgtatgttgtgactgggtgtatacacatccatatacataaaatatttcaatatattatattttgtatatatgttatatatgttatatattatatagtaatataaaatatatttaagacatttttataatctatattgttatacattatgtaaatatatgtatatataaattatatacttataaatatgttatatgttatgtatattatatatgctatatgtattatatgttatgtcatatataatttattgaatatatttatagtatatgaaacatatatagtctgtcttcttggaaaagcatacaaacaatgagactccagatccagatttctttttttttttgagacagagtcttactctgtcacccaggcaggagtgtggtggtgtgatcttcgctcactgcaacctctgcctcctgagttcaagcaattctcctgcctcagccttcggagtagctgggattacaggcaagcaccactacgcctggctaatttttgtattcagatccagatttctaaatgtctttctccagtt

SEQ ID NO: 99403 - DNA, 551 bp, Homo sapiens
agacaagtcataagataaaatgttaagatgtgttcccaggctttccttctttttcctttttcactatgtttaattcctactactagtcttttaaaactggttgtatataatactcattagtttgttcaacgttgtggcccaattatttggccaccgtttgcagtcttaattgtaggacaggaatgttaagtctaatacttctttgtatttctggtgctaagcatagtgatttgtatatatcgttcaataaatattggttaatattaaccaggtgtgttggctcacgcctgtaatcccaatactttgagagcccagggacaggcagattgcttgaacccaggagttcaagatcagcctgggcaacatggcgaaaccctgtctctacaaaaaaaaattacaaaaattaggtgtggtggcacacccctgtagtcccagctactcgggggcagaggtgggaggattgcttgagtctggtgggagacccaggttgaagtgagccatgattgtgccactggactccagcctgggcgacagagtgagactccgtctca

SEQ ID NO: 99404 - DNA, 515 bp, Homo sapiens
gtgacgaaggaaggcttcctggaggacgagactggagagcttacttgtgaggagatgatggcataggtgaacagggaggcatgggcctcactccgtgccaggaagaagagcggacagtgtgggagctggaactgggaagaggcctaaccggggcgtgggcttaaatggtcccatccctctgcatggtaaatgcgcctgacagcaatcacttaggcacaccctgagaatggccctgtatggcagcggcacctgcatggggttcagggttccaagctaaggaatccaggagaggccaactggagattcgttccttatctatgaggaacatctgagcagcttccccgccctgctgccaccactgcatgcacagggggtctggactgtttgttttggggtatgtgaaggctgccaggtggagattgtcggggaggtgccaagtggacatgctattgctatataaactgcatgccttttgaaagcggttgtggttctcccactcagcccgctgccactgg

SEQ ID NO: 99405 - DNA, 693 bp, Homo sapiens
tgagtgttaaatggccagcaggaattatccactagagaagcggaagggagagaatggaaatggccgcatgcagctcctctccctcagacagctcggggctcagcggaatgagcacagtctgcaggacaagtgcggaggacttcagtcccctctactgtatattggctttaggactcaagttgtccctgaaatagaggaaggtgttttctagggtagtggtaattatcacagtcaaaaaagtaggcgagagcacttaggaaaactgtgcggagatcggctgctgatgtgtaaatactgctgaagctgcttattcaagattagaaaacctgagacccagacgggggaaactgctttccatggttaatcgtcaacaactggccaggatgggacagaagcccatacatagccttcattccagggctcagaacaaaaagaaggcagtggcctgggctgcacctgagcttggcttcacataggagggattctggaacgcaggatcctgacaacgacctcaagcccctgtaaagcaacacattttttggcaagaatccctgggacagagaaagaatttcttctcacttattattgagaatgttctcatgtcttgcaaggctcactgcccagtagaagctgaaaagattcagtatgagtaaaagaagagatctgaaatttgcagcttgtcatagaaaggta

SEQ ID NO: 99406 - DNA, 399 bp, Homo sapiens
caacaaataacgtacccagtgctgaaaaggataatatccttaacttcctctcagggtgcttgtgaaggtcaaataagacaccacaggtaaagcactcagcaccttgcgtgacacagtacctgcatcataagcccagctgtcattattgctaacaacacgtgcaagccgctactcagggccagaccctcaagtccacagagatgaacacgactcctgccctggggaatttgtggtttatggttcaggagttaatggattcaggtagaacagcctgaggcaggcccatccaggtaaaggcatcccccaggaggaagcctcctgattattcactcctgttggaaattgaggaagttggaagggtcctaggcagggagcggtgatgagggaaagggcccagaa

SEQ ID NO: 99407 - DNA, 444 bp, Homo sapiens
aatgaataagtatttccgtcaagaaaaaggaaacaacaaaataaaaccaacccaagtaaagaacagccactgcgcctgaccaatatatttccatattatcagtttataatattcccacaagcttcctaaagtagaaatcatttgcagtgagcagtttgccccaaaagcctgaaccgctgggaactcgtcctccaccttccccatgtggggcacttggacgcacgcctgtaagggctgcacatgccatttgccattttgaaagtagatggtcagatgacagcatataaacacatttttcttactagaaagtgtcagctgggcatggtaactttcccctataatcccaacactttgggaggccaggggggagggatcatttgagcccaggagttcaggaccagccacaggcaacatgacgagatccccatctctacaaaaaaaaaa

SEQ ID NO: 99408 - DNA, 381 bp, Homo sapiens
gaccagctccggggagggacccctggaggaggcgcccacccctccctgctgaccccaatttccaaaaagcccattcattcatcccggggttgggggtgtgggggtggtcggaggaggacccccccatcctgtcctgcacccccagtccccgggggggcgcaggatgggggacccttagcagcggtggcgaccccgaggaggcctgggcacaggaagaaagaaagatatttctgtctccctccccgcctcaggtttcgcccttcccttcccttcccggggacaatcccgaccttcaccgtcaaggccttttgcaaacacacacgcacgcacatgtatttttggaagaaggggaaaaattccaagagaacctccgctgggtta

SEQ ID NO: 99409 - DNA, 338 bp, Homo sapiens
aacactgctcccattgaaatagctattttattggcacttagaaagtcagaccctagtaaggaagaaaatgttttatatgtcaatatttaccctgcagaacagacaacaaaaggggagtagagcttaaggcaaaacaggaggtatctgggttaacagccttctaaaatgaaagttgaaaagcactggcccgagttaccaagaaggctctggaccctctttccacttaaaatgttaagacaagtcatcacctcggttcagaatggtatggcacaatacggcttgaaagcagagaaacatgctatgtgaccttctaaggacccttgcttttttttttttta

SEQ ID NO: 99410 - DNA, 716 bp, Homo sapiens
ggattaacatgacgaggaaagagtgacatttagctgagggtattaagtagatgtctcagatgaactgacactaaaggtaattagctttacaaatagagagatgagagaagagaaccacttcctaggtaggataaaagaacatgtaaaaaagggatatgaaaaaaatttatattcctttaaaaatgttattctctaccagcctaatgagtatttccatgtgatagaaatagagataaaggttgctcatagaggtagtggcaggaaatgaggtcaaagagggagatattccagtaaggaggctgttgaacactttttaggcagaatatcattgttttctatagtgaagccattgggaaagttgtgtacaattacagatgaacttctgcaagttaaatggacaaccttttgtgatgttggtgcttcagaagtactctcaaagggttgctttacaatattgaaaatgctaaaaaatggccgggcacagtgtctcacgcctgtaatcccagcactttaggaggctgaggcgggtggatcacgaggtcaggagttcaagaccagtctggccaagatggcgaaaccccgtctctctactaaaaatacaaaaattagccgggcgtggtggtggatgcttgggcgcctgtaatcccagctactcgggaggctgaggcagagaattatatgaacccaggatgacggaggttgcagtgagcttaggg

SEQ ID NO: 99411 - DNA, 428 bp, Homo sapiens
catttcccccttcctgtatttagagctattgttgtcattcctttgtatagtaccttggtgttgttttgctgtttatgtttatcctgctcaaggagttgtttgagcttcttgaatttccattcctgttttccagagaaagtcaatttgaacgtgttttttcttttttttttttttcttttgacagggtcttactctggcacccaggctggagtgcactggtacgatcttggctcactgcacacctcccagactcaagtgatcctcctatctcagcctcacaagtagctgggactacaggtgcgtgccaccacacccgggtaatttttgtattttttggtagagatgggttttcaccatgttggccaggctggtcttgaactcctacctcaaacaatctgccctgcctcagcctcccaaagcactgggat

SEQ ID NO: 99412 - DNA, 368 bp, Homo sapiens
ttagctttctgcatacattgttgggagtgcatctgagaaggagaaattaggtatacagaagcaagggaatgctggcctagcatgaagatgggccacatcatgcccagctaccaagggaagaacaggcttcatcacaagatctccaagcatccatgatttgacttgtatcatcttatacattcttactatgtattatgtgattttataggaaatataatataaatcaatatataacttcatattcatgttaatatatagctatgtctttatccaaactaaaatataaattatactttaagacattccaaaagatttaatagagttggtagaaattaaatagctaataaataaatactagtctcattttc

SEQ ID NO: 99413 - DNA, 1114 bp, Homo sapiens
gtcgttgctggccagcacttgtgtagaaagatcgctcttcacaccagatttcacttttgatccttccagctccagggtctcgggcttcagctttgtgccgaggcaccaacactgctgcggtcctctctccgactgatcgctgatctcaccgttcccgctcctgtctcctggaaccatgtctctggtaagccagaatgcacgccactgtagcgcagagatcactgcagattacggcgacggcagaggtgaaatacaagctactaacgcctccgggtcccccacctccatgctagtcgttgatgccccccagtgccctcaggcgccaatcaactctcagtgtgtcaacacttcccaggccgttcaggacccgaatgacctggaggtcctgatcgacgagcagtccagacgtttgggggcgctcagggtccatgaccctctagaagacaggtcgattgctttggtgaatttcatgagaatgaaaagccagacggaggggtctatccagcagtccgagatgctggagtttctcagagagtactcagatcagttccctgagatcctcagacgagcctcagctcacctggaccaggtctttgggttgaacctgagagttattgatcctcaggctgacacctacaatttagtcagcaaacggggtttccagatcaccgataggatagcggagtccctggacatgccaaaagcaagtctcctggccctagtcctaggccacatcctcttgaatgggaaccgagcaagagaggcctccatttgggacttgctgctaaaagttgatatgtgggataagcctcagaggatcaacaacctctttgggaacacaaggaacctcctcactactgactttgtgtgcatgcgattcttggagtactggccggtgtatggcactaatccccttgagtttgagttcttgtggggctctagagcccacagggaaatcacaaagatggaagccctgaagtttgtgtcagatgcccatgatgaagaaccctggagctggccagaagaatataataaggccctggaaggtgacaaaaccaaagaaagaagcctgactgctggcttagagttctggtcggaggacactatgaatgat

SEQ ID NO: 99414 - DNA, 266 bp, Homo sapiens
atttataatagtccagtctccccatagagactgcctaaggctatagtgttatgctgctttggggtgggagcagtaggccaagttcaagtcccaactcggaatttgtgtgtgtctcttttgaaggggggaagggactctggaatatgaattatcttcacttgttaatcctgaacatgcctctgactcatgagtggcagcagtcatgggagcaactccagcctttctcagcagatgtcactattactgtgtatgttgaagtatttaca

SEQ ID NO: 99415 - DNA, 479 bp, Homo sapiens
agagttggagaccggctgggtgaggttgctcacgcctgcaatcccagcactttgggaggccgaggcgggcggatcatgaggtcaggagatcgaagccatcctgactaatatggtgaaaccccatctctactaaaaggacaaaaaattagccgggcgtggtggcgggcgcctgtagtcccagctactcgggaggctgaggcaggagaatcgcttgaacctgggaggtggaggttgcagtgagccgagatcgtgccactgcattccagcctgggcaacagagcaagactccgtctcaaaaacaataaaataaaaaaagttggttgctacaaaaaaaataaaaataaaaattagccaggcctgctggggcacacctgtagtcccagctacttgggagggttacacaggaggatcaaagaaacaaaaactgtcggtttcacttcaaaacatgctccgcgtcagtcctcagggaaatgcaaatc

SEQ ID NO: 99416 - DNA, 113 bp, Homo sapiens
acatagttggtaagtgatagaagtgggactcctgtatcagtatgtctccactttgactaagggaactccaaagtcaatttatccaagcttcagggatcttgattttgtaatac

SEQ ID NO: 99417 - DNA, 351 bp, Homo sapiens
tagagggactctggcatatttgggatcatgttaacacttttcgatgtggtctttgagcatggaggaattattataggtttttagtcacaggattacatcataaattatctttgaaaaataccctggctgcattttgctggatgtattggagtagaatgaggatggattcaaggacagcagtgaggtagttactgtgataatcaggtgacaaaaagatggtggcttagactaggctggcagcaatagagatgtagagaagtgggtggattgagatagatttggtggtaaaaatcaatagagcttggctatatggtaaatttagaggtacgctgggaataatggagtggggga

SEQ ID NO: 99418 - DNA, 481 bp, Homo sapiens
ggagttctgggaaagaaagatgtggctgggctgatggcgtttcaggaggaacagcagccagggcctgcatggggcagggcagggtttcctctcctacgataatgcgggacagaacatcctaaagacaaggagcagacctggttctcctccctcttctgccaatttccagctgtgtggctttaggcagatcagttaacctctcaagcacaattcactcggaggatggagagcgtcagaaagtgttccaattcatacacattatatacaggcatcaaaatatcacatgaggccgggtaatcccagcactttgggaggccaaggcgggtggattgtttgaggttgggagttcaagaccagcctgggccaacatggtgaaaccctatccctattaaaaatacaaaaattagccgggtgtgttggtgggcgcctgtaatcccagctactcgggaggctgaggcacgagaatcacttgaacctggca

SEQ ID NO: 99419 - DNA, 809 bp, Homo sapiens
ccatatcctgttctgttgttggatttcattcttatactggttgcctcattataagggacaatttggacacagagacagaacacatagaggcaacacgatgtgaagaggcacagggagaaaattgccatctacaagtctgcaccatatccttccctcacagccttcagaaggaaacaagtctgtggacaccttgatgctggacttagaggcctccagaactgtgagacagtaaaattatactcttcaagccaattcaagccaatctctctgatgatttctgctcaggtctctttgtccggaataagtttgtataatcaccccaagatgctaataaaggtgtggtggtgatgggagacaagaaaagatagcccattcttatttttgccttttaaaatttcagtactgggacatttcttccttgaaaaaataaacttttttgttgacccatacaaaatggaatgatagcagtgcccaccgtaacagagacttcatttatttcaccacttgtacacattttcacttcatgtagacatctgattgttctatgagagattctatgattgttctatgagacccagctatatttatgaagatgaatattatttaaacagatagataagattaaaagagaagatagactgggaaaaggatacatttagtatagatttcggggagtttgaagcaaggcaactatgatataattctagatgtattatttacattttataactttttctttccaaccattctccacacttcatctcacaggtttttaaaaaactaatctatttactaaatagtatgccact

SEQ ID NO: 99420 - DNA, 317 bp, Homo sapiens
aaggtaacaggaaaataaccaaacacttggaaattaaataacacacctctatataacccatgaatcaaagaggaactctcaagagaaattttaaaatgcattatactaaatgaaaatgaaaatgtagcatatcaaaatttgtaggacacagctaatgcagtgataatacatacattagaaaagaccaaaagtctcaaatcaataatcaaagctttcaccttgagaacccaaagtaaaataaatacaataaaagaaaagcaaaataaacacaaagcaaacaaaggaaagaaataataaagagcataaatgaaattgaa

SEQ ID NO: 99421 - DNA, 167 bp, Homo sapiens
ggtacatagcaggactgcctctcctagcatcccttgcagctaggtgaagtcatgtgactgcattctggccaatgaagatggcacagccaccagatgaaagaagcctgatccctaactaatgtgtggagctgagtggaggggagcaaaaatgatgaccctgggctgtg

SEQ ID NO: 99422 - DNA, 485 bp, Homo sapiens
  misc_feature (474)..(474): n is a, c, g, or t
  misc_feature (476)..(477): n is a, c, g, or t
  misc_feature (482)..(482): n is a, c, g, or t
atttgttttaattaactgggtctggtagtgcatgcctgtagctacttgggaagctgaggtgaggcaagagaattgcttgagcccaggaatttgaggttacagtgagctatgatcataccactgctctccagcctgtgtgacagcctgtagtgaccctatgtcaaaaaaataaaaaaaaataaaacagcatgcagatttggcctacaggccatagtttgccaacccatgctctaatacatagtttttttgtttttgttttttagtttttttgtttgttcagttggttggttttttttgagacagagtctcgctctgttgcccaggctggagtgcagtggcgcgatctcggctcactgcaagctccgcctcctgggttcacaccattctcctgcctcagcctcccgagtagctgaagtaggaggactgattgaggcaaggagtttgaaaaccagcctgggcaacatactgagactnannctttncta

SEQ ID NO: 99423 - DNA, 548 bp, Homo sapiens
agagtgggcaggggaggagatacaatatgggaatggggcggtagaggggtgggatttcatgaaatttcctgatttaaggcgatcatgaagtaggcctctttgggaggttggccctccagtcgctggtaagggtaacagcccaccagtctctggtgaggtccagtcgcgtcccccgactgcatttagagccaaaagcagaacgaggccggcgctgcggcctggcgtccagtgacccagctgtctgcatattccccagggtgcaagcacttggacttcaggtgtgaaggcaatgcggtcaccaccgcagtaagaaaagcaactagggaaaatggcaccttcttctcccaacttttttttgagactctcgctctgtcgtctaggctggagtgcagtggtgcgatcttggatttggaaactataatagaaacggctgatctaagattttcatggttatgttttgccgcgcaggttccgcgtgtggtttccgtagtgtagtggttatcacgttcgcctcacacgcgaaaggtccccggttcgaaactgggcgg

SEQ ID NO: 99424 - DNA, 300 bp, Homo sapiens
ctggaaaggggaaagagggaaacttctgggtctcaggaatgttctaaatctagatctgtgtgggagttccatgaagatagacatctgtaaatacttactgagctgtatactttagtgcacttcactcacagtgaaataaatgaataggcattagctaggtgagagaagaggaggagatgttgctggtagaaggaagggcatgtgcacaaaccctgtgacaggagggaatgggataaatgccaggtctagaagaaaaagccagtgtggctggagccacaagagggaacatggtgtgggttg

SEQ ID NO: 99425 - DNA, 410 bp, Homo sapiens
tttccctgaggcttttgaatatgtttctccttctctgtaaattagggaaaaaaaaaaacccaaaacaacctttgtcaatgtgaagaggactgaataagataatagatacaggaaagctcttggtttatttttgagtacaacagcagttagttcccctcacaaagaaaggatgaatcacaagtaaaagttaaaaatgcaccaacaagtaacagatctagagagaaatttttttccctcttaactaaaatagaatagtggtaaggtggataattatcagatgattagggattaagactagcaataataccaggtattggtttgtaagaaatgaaaaatgtcatttttttgtagatgattaaaactatgtacgtttttattcaagcaagaaaatcacatgatttatcatagtc

SEQ ID NO: 99426 - DNA, 761 bp, Homo sapiens
gctctgccctgcatgtcagagttggcatccggctggatccagaggaaagggaaactgctctctctctctcctctgcctccacttctcttggggtaacaaaaaggatcttcgagaaatcatgttcagtatttcaagctctatttctatggcacttatcttttgagaggagtcttcacctcttcagtgatgacttggtaggttgtttggtagggagatcttgattttctgaggatgttgcatttttctagggaatattttgtagttgtgtgtgtgtttagcctcgatccccattaccctatgcgttaggactggcttatgggtcaaaaactgttttatttctaaatgtttaaaaacaaaattcccactggtgatgcctgtgtgacacatttgggtatttagtaggaaacaatgcagtgtttcaaagcttcgagagaagcttcaaaatggacacaattgctgaaaacagaatgaatcatgaacattatctcaatgttttgcataatagacaagaccacggcgttttggttccctgacctgttttgtgtttatgttaggatctgaatcatgttctgggtaaggagaggaggagcgaacactgcactaagatttggtttgccaaatcagattctttggtcaagagtcagtttagggctgggtgcggtggttcaaccctgtaatcccagcccttcgggaggctgaggcaggtgcatcactagagaccagcctggccaatgtggtgaaatctgtctctactaaaaaga

SEQ ID NO: 99427 - DNA, 656 bp, Homo sapiens
acctgccatttttacccatgcttggtccaagagtacgccttccttcatccatatttctagctttctccccacccactcctttctttggaaggaagttattttcctttcctatcactgaaaattctaacagagccccactgagagtcttcttcatcctacgtcctcatttaaagccaaattttactgagcacttactatgcaccaggtgctgagctggggtaacaaagatggagcagccacagttataatccacaaggatctcctcatccaaaggtcctgtttatgtagagtgcttgcttgcaccatgtggacagtgagcatacttctaaaccccaaatctcaacatatggtccaagaaaagcctgcttttctaatttgcgaatgttttataagggtgtctttaaaaggcttacaaattgaattgtgttagtaagtcctataacaagttcctttactagaaaaaaataaattttattaaatcaggatttttgagaaaaatctgtgctgtgtgttctccaaatccatatgttttaacttgtaaaacctccctataatcacagtctattgcagttgggaaggatctgaaatgtcacctaatccagaagatgtaaattttttattttttaacaatgaaacaatttttaaaaacaaatatt

SEQ ID NO: 99428 - DNA, 595 bp, Homo sapiens
ttcgagggcatcagcaagttcaaagtcaacaacaccattcttcacccagagatcgtttagtgccgagtgtttaagacggacatagagctggaggttctgcactacaccaataaaatctccagtgagacccactgtgagttctggaatataaaggagagaaggctgaaaagtgaagggtgcaacctaagactctgaccagtgactaggagttttccagaggaggaagaacgggaaaggcatttcaggaaaaggccagcatgaacacgcatatgaagctgcacgcaggtgcagaaaaagggagtggcagcctattttttctgactgtaaaatggactacaagagaaaattcctgctcagagggtgccctctcttgcagtaaaaatcctttttgaagatggtcaataacatgaggacatagagcagaatcacattctgtttctacaaaacacccccaccaccattttaaactacaaatctgccaaacaaaagatcatccaaaagacactttttgagtgcattgcagaactgggagggtatcttcttccgaagtaatttcatttttcaggcttgcaataataaaatgatcttaagagtg

SEQ ID NO: 99429 - DNA, 888 bp, Homo sapiens
tgccgtgggagggcacagcaaccaggcaccatcttggaagcagagaccaggccctcaccagacaccaaacctgccagcatcttgatcttggacctctcagcctccaaagctatggagccccactctgttgcccagactggagtgcagtggcgtgatctcggctcaccgcaacttccgcctcccgggttcaagtgattctcctgcctcagccttccaactagctgggattgcaggtgcctgccacctctccctgctaatttttgtatttttagtagagacaagatttcaccatgttggtcaggctggtctcaaactcccgacctcaagtgatccacctgcctcagcctcccaaagtgctgggattaccagcgtgagccaccgcgcttggcttaaatattatttaatacatgttaaaatatatgagcattttaagaaagccataattttcagcaaactaacacaggaacagaaaagtgaacactgcatgttctcactcataagtgggagctgaacaataagaacacatggacacagggagcatcacaaactggggcctgttgatgtgtggaggcaaggggagggagagcattaggacaaatacctaatgcattcggggcttaaaacctaggtgatgggttgataggtgcagcaaaccaccatggcacaagtatgcctatgtaacaaacctgcacattctgcacatgtatcccagcacttaaagcaaaataaaaattaaacaattttaaaaaaatatatggacatttaaataatttaaatatgctatgcaaaagtgcttaatatgttaaattggcataatttattagcataataaaaattatttttcacattttaagtatatttatactagatgcagtgatatatataata

SEQ ID NO: 99430 - DNA, 427 bp, Homo sapiens
ctaggggttctggagggtgacagggtggaagaaaatagtatgcctatgaagagtggcaggaaggatcctttggtgttgaaactattatatcttgactacattcataacaagatctggtttttacattgtatgacagttctgcaagatattacccttagtggaaactgggtaaaggatacataggatctttctgtattacttttcacaactgcatgcgaatctacaattacctcaaaataaaaagtttaattaaaaatctctgcacttggatgcctctcatcagctccaggtgtatacattaactgaaagattttcaagcaggggaagtgctttgatttactttttttaaaaaaaatccttagctactgtgtggaatctgaattagaaaccagtgggacaggtattccaagggagcggtaagtcttct

SEQ ID NO: 99431 - DNA, 545 bp, Homo sapiens
actttcctagagaccatggccatgctcctagagggtgaacctgcattcgctgacccctccatgcaaccccacttcactgatggggaaagaggatcccagaggggtaaggaacaagcccaagataatagagcctgcattggaaccgggctgagctaacacttggcttaccggcactgtcactgccagggcccgcgcgaccagaccctggccctccccgggacccaaggtcatctgggcccaggaaaaggcccttaaaacaaattcagttccggtgacatccaaaagagcatattaaaaagcaaggaccagtcaggcgcggtggctcaagcctgtaatccctcactttgggaggctgaggcaggaggatcgcttgagcccaggagttcaagaccagcctgggtaacatagtaagaccctctcatcgctactaaaaatcaaaaaatgaggcaggaggatcactggagcccaggagatagaggctgcactgagctgagattgtgctactgcactccagcctgggcgacagggcaagattccgtcaaagg

SEQ ID NO: 99432 - DNA, 416 bp, Homo sapiens
caggaaggacagagctggggctcaaacccaggcatctgatgcccaaacctgtgttcttttttatttatttattagagacagaggctcattctgttgaacagcctgcagtgcagaggcgtgatcatacctcactgcagccttgaactcctgggctcaagccatcctcccacctcagcctcccaagtagctgggaccgcagacacctggctaatttatttatttatttatttatttatttatttatttatttatttatttagtagagactgggtaacatagtaagaccctctcatcgctactaaaaatcaaaaaatgaggcaggaggatcactggagcccaggagatagaggctgcactgagctgagattgtgctactgcactccagcctgggcgacagggcaagattccgtcaaagg

SEQ ID NO: 99433 - DNA, 680 bp, Homo sapiens
agcggagtaggctactgttgctctagggtggcaggggttagggaaaaatcaggagaggctgtaggctactgttcatctaggatggcagagtttagtgaagaagaggaagacactgtacgctactgttgttctacaatagaagatgttcctgaagaaataaaagaggctatagcctacttttgctctaagatggcggagattaacaaggagccagaagggaatataggccaccattgctacattatcccaaaggttaccgaagaagtaggagaagctagttcagacatgcctgaaccatccacaagcacaagccaagaaaatcccagcatgaaatggagaaagaaaactacttgtgaagctaaagaaggtgaaactgacgagttgttgaaggcagcaaagaagataagatcatttgttcagcagaattcagaaagacgtaaagcggggaaaaagtcaactgtattaattttttattaccacagtaataaaaaaagggatgaaaatcagccaagtgaggatgaagacagccacgagtaatctcccacctcaagtgattctgagagctcatcagaagaccaagacctatctcatctctaggttaacctctagaaatggtctcctgtgcagagaaactacatattgcaccaagattcttggatgttggtgattaaaattcaacc

SEQ ID NO: 99434 - DNA, 287 bp, Homo sapiens
aagtgtatttaatcatccacttatctgttaacaattatctctgagggcccgtcacattcagagaagattctaggttctctacaagtatcctctcactgtgtacatactaaatcaacatcctgctggatttcccccagacatctcccttcatcaccattggagagtatcctctaattgccagccctattcaccatactcatctcatttgatctggagttttctgagagtgaccgggggtgggatggacaggataatttagcaagagtgtataagtaaaatctatataa

SEQ ID NO: 99435 - DNA, 419 bp, Homo sapiens
taaacccagacttttatgtgaaatagaaaaaaaagactataaatctagaaacagttactctggattattttttcttctggaatttctatttgtattcagcataagtaataaaactgtttaaaaccccaagccagccctgcatgttagggcagtgggtcactagcttgtgtctgcagactttaagggggaattgccagagaagcaggaagtcccacctctcctggctgttgggattgtgagtatggcctgcctcatcactaatgacaaccagctctgctggaagggattgcaaattgctgtgtcttttgtctatttagaaccactaggattggcaggaaatgggaggcaaagggacaaggtggaatgactgacaggcctgttcataatgtgttttagttttcatttttaacttgtcttca

SEQ ID NO: 99436 - DNA, 816 bp, Homo sapiens
ggacttcagagaatcgttccgagaattttctgggaaaatatgcaacagcaggtcataaaacagatctcacagagatatgtgagatcaataggtatgtgctttgggccacatgaaactttaaaaaaatgtatcttaaaatttaaaataggaaaatattatgtcagaattcaaatagtgactgaggaacagataaatgtgtctatccacacagtggaatattattcagccataaaagggaatgaatacatgctacaacatgggtgaaccttgaaacacgctaagtgaaagaagccagtcacaaaaggataaatatgcgaacggatccaggtgtccacactgcatttagttgtcatggttccgtctcttctggtctgtgagagtttctccatctttccttgtctgtcatgactttgacattttttgaagagtgccggtcaggtgtttggtacagatttgtagtatttgtggaaatctgctggaatgagtacccttggcctacgaggcagagtcgggggtggtgagctacaccctgtgggacaaatctaggctgctgcctgtgtttgcaggtctccgagctaagaatgggtttcacatttttaaatggttgaaaaaaaaacaaaagacaaataatagtccatgatatgtggaaattatcatgaaatccaaatgtcagtgtccataggtgaagtggggctgggaggcagccacgggcattcttttctgtgttgtccctgggggcttttgcactacaatggcaggattgggaagtcactacggaggccctttggccccaagagcctcaatatttactccctg

SEQ ID NO: 99437 - DNA, 234 bp, Homo sapiens
gaaagagaacacataggtgtgtttcctttcttccaaaccagcaagtggcttgtttactgatcattttagttacaattaggaagtttctcattttttcagaaagtgggatttttgtgtctagttttcctaatgctaattcaggaaactttctttcttagaattgtctaattcttccacaactgttatagtcagagggacagagagaaaaaaaaactttctgatttctcaatgccc

SEQ ID NO: 99438 - DNA, 201 bp, Homo sapiens
aaaaaaaaaaagggaactgggagcagtcttaaattgtttattaaaaatgtcagcaaaatgcattgctaaacaggcccatgattttagaaatatgaaaaatgagtacagttatgtggcaattgcctctggaaaatcatgtgcagttgtgactttcatcatgcgaagttatgatttcatgctaggagagatataaaaggatta

SEQ ID NO: 99439 - DNA, 405 bp, Homo sapiens
gtcatggggtgaagaaaaaacgttctcataatgaatgaatacatgtggaatctcagcaagaaatgcacattattaaaaagaaccaaatagaaagataatgaaattttaaaatagtacttttaggttgattcatagattagaaaaagacagaacaatagaaattactgaatctgaaaaaaaagagtaaaaaaagtttgaagaaaatggacagtcttaccaataaatgcggtacaaaagtaacaactaatagctgaaaactattggtcaaaacccccaagttttgttttttttgttgttttttttttttgtttttttttgagatggagtctcactctgttgcccaggctgaagtgcagtggtgcgatctcagctcactgcaagctctgccttccgggttgacaccat

SEQ ID NO: 99440 - DNA, 299 bp, Homo sapiens
tggtgagtgatctagaggatcccatgggtgctccatccccctcccctttatggccacagtcatttacttcttgccctcacacccttggttgtcttttgttttctttttgagacagagtcttgctctagcctgggagagaagaacaaactctttctcaaaaaaaaaaaaaaaaaaggggggttggggggaaaaggatggaatattaaacggccctttgtggaaattcggggaaaataaacttgggagggaaaaaaccggcggtgcctaaccttgtgaccaagcgggggaagggtggtcac

SEQ ID NO: 99441 - DNA, 719 bp, Homo sapiens
actaaataaataacgagcctaatatttaccagtactagtaaaaatggcatataccttacaaaacatttgtcatcttataagatgcaaatcacattgattccctgattgatcataagacagagtatgtaagacagccaacgggccatccacacacaccaggaggaagactgttgtggagttaagggtgctggcaaacagcaactttaaacatttttttacattaaatttgttattttttaaagaaggttttttttcattaactattttagaaagcctgaaaaagtaattcccagatagcacattaaatgctgtgaattatgttatactccatagtaggttgctatgtggtttcttgattttatcaaaattacatccaagggaatgaaaaccatttgtctacatttaaaattcctcatctctacaactcaatatttttccttgatgcattctaaatgccctagtagaaattattttgaaaagaaaccattaaaggtatgctaatgactctgaattgtgacagatgctagggaaacaggcctgttggctgaggcacagcacccttaaccatctatcataaagtactccggacctgctcattcattactgctgtgttgctcaaggggagagaaaaacagcaagagtttctctttctgaggcaaaaatcataagccactcactaattctaatgtcatgatcccccactgtttgtctgcatgata

SEQ ID NO: 99442 - DNA, 567 bp, Homo sapiens
gctttgagagattaccataggaattacttttgagctgatctctaaattaagatagggacatcaggaatgatgccttactcaccattgtattcctggcgcctaacatagtgcctagcacagtgtagacactctgtgttttgattaaagaagacttcagtagataattaagaggtacagaatccacacagaacaatatgaaccccaaaaaaggtttgaaagtattgggaaatagtggtcgaggtaaaacatgcagttctttgaagacgtcttagtagagttagactggaaggtagattggagccatcttatggagggctgagagaatgatggtgccatttacttagatacgagataaggaactgaaaataagtttaatggggacaataatgaattagatacgttgaatatgaggtacctacagaatattcatatgacagcttttggtagctaattgatggttacagtgtggagctgagcaaaattgagtctggggatgtagataatatgttagcctttaggagtatatgagatcgcaagcagagagaatagagcaagaagtaaagaagg

SEQ ID NO: 99443 - DNA, 134 bp, Homo sapiens
cccacccagtcatgccgggaccagcccccaaacctgaccaccacagccagccccagacatgcccagtgtcccctggacaggatcacacctgggtgagaccctggtccaaagcaagagaggcgtggctgcgagca

SEQ ID NO: 99444 - DNA, 184 bp, Homo sapiens
ggcaactggacatataagcagtaagttagaaacacataacagagttagaaacacataacagaggcttctattctagctttttgtgtacttctgctacactctgatcctctagaaggctggtattgtttctgatttattataaactccctctttcaccagatatagcatgatatccagcctagag

SEQ ID NO: 99445 - DNA, 2483 bp, Homo sapiens
ggatccgcggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtc

SEQ ID NO: 99446 - DNA, 2455 bp, Homo sapiens
ggatccgcggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtc

SEQ ID NO: 99447 - DNA, 930 bp, Homo sapiens
  misc_feature (926)..(926): n is a, c, g, or t
ggatccgcggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagttgcccgttatactggcataatatccaggccaacttangact

SEQ ID NO: 99448 - DNA, 2396 bp, Homo sapiens
ggagcggctctggcatcacctcggagctgacgaagcgggaagagccccgcaccagtgctgcccctacagagctctcggcggggggtggaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtc

SEQ ID NO: 99449 - DNA, 1774 bp, Homo sapiens
tagaaatggggattcaccatgttgcccaggctggtctcgaactcctgggctcaagcaatatgcccgcctcggccttccaaaatgttgggattacaggcgtgagccaccatgctgagctgaggatcacttgttttaactgctgggaatctcccttcgttgggcctggctgtcgggaaacctgggtcacaagcatgacccttccccgtcccccctcaccccagatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtc

SEQ ID NO: 99450 - DNA, 2523 bp, Homo sapiens
ggatccgcggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtc

SEQ ID NO: 99451 - DNA, 2262 bp, Homo sapiens
ggagcggctctggcatcacctcggagctgacgaagcgggaagagccccgcaccagtgctgcccctacagagctctcggcggggggtggaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtc

SEQ ID NO: 99452 - DNA, 1532 bp, Homo sapiens
ggatccgcggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctggtgagcctgctgttgggctcgaggccccacctcaaagcatcttggatagagtcctgagcctgaggccctgagagaggccaggggaggtggaggagacctggtctcagccctgacccccagagaagacactgaggggccccagcctccaggccaatggtatggggagggatccagacacctcaggcaagccaggcaggcccaacactttcctgtccttctgcagaagtttgcccgctactacctggccaataaatcatcccaggcccaagctcaggagctggagaccaaagctgagctcctccagtctggtaagccctgagaccctcctggggaggtgggagatgcagaggaagctagagccacctcccctgggaagctgttccatctgttcccagccagagcccacccctagtagccttgtgcaaacaggaagatcatgaagggaagttggtaggattaaagtcatccctgctgttgtttgggcctcagtttccacctctataaaatggggaggcgacagaggttccatgcatgcaaactttggatccgaagacctctgaattggaatactagtttcacaacatcccagctgtgtggcctgagacaaaccacttagccactgcacccctctgaacctcaatgtgtca

SEQ ID NO: 99453 - DNA, 476 bp, Homo sapiens
atccttcagggcttgtaggttctgatgccaagaaaagacaggaatttgccagagttccctacttcctagcctttggcctgcttccatttgacaagtcacatatcatcatcaattcatgagtgccttcctaagacatcttgacccatccttttctcagcccctgagaaaaggattccttcctcatatgactgtcagaaagactgctcaccctcctgcaagactcttcacctaccaaaagagattaatctttaaaggcctttaatcataaaatgaccatatcatacattagcaaaaggtggttacttcctgttgggaaagtgctatcagagaagggggggaggaggctgggcacagtggctcacgcctgtaatctcaacactttgggaggccgaggcgggcagatcacttgagggcaggagttcaagaccagcctggccaacatggtgaaacctccatctctattaaaaatacaaaaa

SEQ ID NO: 99454 - DNA, 219 bp, Homo sapiens
gcggccgcctactactactaaattcgcggccgcgtcgacttgcacttccacaaccctttctcacctgcctcccaggctactctctgccccagaaagcaacttaaaaaatgtgcagatggagtttggactttacctgaaaatggtgggagctatggaaaaccttggagcaggggagtgaaggatagaaattatatgtaaaagaaaccctgggccgggcgc

SEQ ID NO: 99455 - DNA, 210 bp, Homo sapiens
gcatgggtgagcatgaccagtgccagcacctgtacgtgaatacacgtccccagcagtgcagagtccagcatctgatgaaaacgtgatcagacagagccctgtggcctaacactagagacttccctctctagattaacaacaaagaacttatcaatacttttgagcaacgttttttttctgaccagtcacaaatggcccgattgtacagcc

SEQ ID NO: 99456 - DNA, 189 bp, Homo sapiens
gggaggagagggatggcggtcgaggccagatcagggagagtggggtgggcaaggggatgaggaagggggcccctttccatgccggagaccacacgaggacgtgcagaaatgggcggggacctgtgcggaacccctgaggtccaagcttgggattctggaacccggcagtgtacctgtagccacacgggg

SEQ ID NO: 99457 - DNA, 306 bp, Homo sapiens
gcttttgagtaggaaataacctcttttcagtgtcttttatcaatttcaagtaaaattaaactctttaaaattagaatggtaggaaaacaggccattctgtttatctgacatcaggttaagacataattgtatgtatgtcatggaaattaccacattcaaagaaatgacatgcaggattcaaattgaatgaaatgtaagattaacataatttcatatttgtcaatcagaaagtccttcaagatttaaaaataaatcaagattaattactattgtataatactattaaaaagtgttttgaatttttta

SEQ ID NO: 99458 - DNA, 1413 bp, Homo sapiens
  misc_feature (1413)..(1413): n is a, c, g, or t
cagtagatctgataactgttggctactaagtgactaaggggcaggtgaagtatacagcttggatgcgatggacaaagaggaagatctacctcccagctgggatggagcaggacgatgcaagatttcatcacactactcagaaaggcatgcagtttaaagctcgtaaattatttcaggaattttccatttaatattttcaggctgtggctgaccgtgagtaacaaacccaggaaagcgaaactgcagaacagtggatgggagaaagggtgaattactgtatattcatgagggatattagtccatagtttcttttttcccttttaacaaatttttgggttttgtatatagtttgtctggttttggtatcagggtaatactagcttcataaaatgaattggaaagcgtttcttctgttttcctaaaaagattatatggaattagcattcattctttaaacacttggtagaaatcttaagtaaaaccatctgagctcggagatttttttgtgtgtgttataaaattacatattcagtttccttaatatttataagatcattttaattatctgtgtttttcagtgaaacgggtcaattttctgtatgttgtcaaattaatatttgtagaattgtattagtattcttcattatccttttgatgtctgcagaatctgtaatggtatccctgttttatttctgatattaatttgtgccattatgtctttttttctttgttgatcttgtcagaagtttgtcaattttatcaatttgttccaagaaccagctcattgatttggtttcagtttcattgatttctacttttatctttattatttccttctttttcttgcttttggtatattttgtgcttctttttctaggttctagaggtggaagcatacgttattgatttgagacctttcctcttttctaatgtgagcattttagttacatttagttccctcctaggactactttaattggattattgagaggtgttgaagtctccaactgtatttgtggatttatttatttttcctttcagttctattagttttagcttcacattattttgcagctctgatgtttaaaggtgcatgaacatttaggctcactatgtctcagtgaattgacccttttatcattacgtaatattcctctcagtctctggtcattttctttgtgctgaaatatactttatctgataatataatgactgttccctgtagattaatattttcaggatgtatcatttttatttttttattttcaacctgcctgtaatcattatatttgcagtgaattttttctagacactgtatagttaaatcatttaaaaaagtctgaaaaactaaaaaatccctctaatacctcttcgagcgcggccccggtaccctccgcctataggggtccgttn

SEQ ID NO: 99459 - DNA, 533 bp, Homo sapiens
catctaataccactaggagtccactgaaaatgttactatgttaaactattaatcaaaagtttaggaagatgtcattaattttacatttctacctgaatcacattgaaggcattcaacatacaaacacttgtatagttttttctaattaatatttatgttatttttttccctgattaaagaatcctggcaatcatctaacttttaaatatccttttttgttaaaatattatgctcttgttctcaaattatcggtagaatttagatcaattttaacaacaagtttttctttctattcctctttgcttatagcacttaactttctttctctgacccctcctgtgcatttaaaaaaatgaaaacccatactcccaaactgaaatatttgttctctttagtaagattctttctggcttcagggagaataaatttacagagacattctgggactttgggactccaacgattcaaatttttaccttgagtatctattcttgacttttccttctttttgaataaacatcccctaaagagaa

SEQ ID NO: 99460 - DNA, 364 bp, Homo sapiens
tgaaaagtccttcgggaaaggaacatgcttaactttggaagatctggcattttcaattctaatttttataaaagatacatttaaaaaattttaaatacttttatggaagtacattttacatgcagtataacacgcagactataagtgtataatttagtaagttttgatacatatatacacttgtgtaatcaccacccaaatcaagatgtaacacattcctatcgaccctctaaaattcactcttagactgtaccttccagtcatcagaaactactgttctggtttctattatgatatagtttgtgtatttgtccccacccaaaatctcatgttgaaatgtcattaccagtattagaggtggggc

SEQ ID NO: 99461 - DNA, 395 bp, Homo sapiens
aggtgggaggcaggagctgacggagagagaactgctcaggtgttataacccgtgaacttttccaggaagggtccaaagcaggaccaagacccatctctctgcaggtgagggcatgacacaaccaaagacattgacctggccttctgcccagcatcacattaagcccagggctctgtgaatcacatactcactggctcccctgcccagccgtcagtcccacgggagggctaagattgggagttgcagagaaaaccaattttttctaacattcaagctgatgggagaaacaaatttgcaaagtgaacacaaggtactttttttttttttttttggagaagggaaatatttgggctcttgttgctcaggctggagtgcaatggtgtgatcttggctca

SEQ ID NO: 99462 - DNA, 360 bp, Homo sapiens
tcctgggtgaggagatgccccacccagcttcagctcaccctccatgggctgcacccactgtctaaccagtcccaatgagatgagcccggtacctcagttggaaatgcagaaatcacccgccttttgcattgatctcactgggagctgcagatcgaagctgttcctatttggccatcttgccaaccacctccagtgcatttgttatttctctaattgtgttcttcatttccagaaattgtgattgttttttatgtatgctatctatttcactgaggaattttcctttcatatcctgtatcatgtttgttatttctttaagttagaattcacctttctctagtgcctttttgattagcttaa

SEQ ID NO: 99463 - DNA, 569 bp, Homo sapiens
ttctcccacttctggaggctaaaagtccaagatcaacgtgtaggcaggtttggtgtctcctaaggcctctctccttggcttacagatggctgccttcttgctgtgtcttcacgtagcctttccttgtctctctcttcttataacctttgttaccttcttaaagctcctatctgtaaatacagtcctgttgcgggttagggtttcaagatatgaatgttgagtccctaagaatgcacatctgcgaagtgatttttcaggcaaatgtggtttttctttcagacatttttaagttaatccatttgaaatattttctaaaatatcagactagaaaaaatcaagagtaatataataaactgttttatgttattttgttgtgagaattcattgggacaaaatccctgatcattattcttttttttttgcagccaacaaaagctgttctaatggagctctggtgtgtgcctcctccaacagctcgctgtgatggttttgccgactgcatggatttccagcttgatgagtccagctgctccggtaccccatttccattcagatattcttgtgatatg

SEQ ID NO: 99464 - DNA, 599 bp, Homo sapiens
  misc_feature (557)..(557): n is a, c, g, or t
agcaaggaagggacgttcagaaggggatgaatgaagcatggagagcacactgtcaatggaggaggagagaatttcaacacagagaaggaatgttagcaaaatctcacggcggctgtttgaaagtatgcacaccttctcaagcaccatttgtctttttaaaagaaaagccaaatacaaatggaaatgctctgggaggggagagataagaggtgtgcctcccctgctctgaagtcttgggtctttttgggtgcgaaggctggagtcaggtgtcctccggggactcaccacccgcccgagaggggagagacacatgcgattctggaagctgagagcattgcttattgttgattccttggttgccgtgctgagtcctgctttaaggaagcaggtcgcgtctccttcttcacctcggggtccgagaacctacaccgcgtggagaaggtccactggggcacccgttacgccattaccatcgccttcagctgcaaccccgagcatggcatcgaggacccagcgttcccgtagccagcagctgggccaaggtaacttcaggaggngccgtgtggaggcagccgcgccagtcgtgcacccaaccccaa

SEQ ID NO: 99465 - DNA, 434 bp, Homo sapiens
agcaaggaagggacgttcagaaggggatgaatgaagcatggagagcacactgtcaatggaggaggagagaatttcaacacagagaaggaatgttagcaaaatctcacggcggctgtttgaaagtatgcacaccttctcaagcaccatttgtctttttaaaagaaaagccaaatacaaatggaaatgctctgggaggggagagataagaggtgtgcctcccctgctctgaagtcttgggtctttttgggtgtgagaacctgtcttacccaagagtgagaacacaagagtccacacctacttcacaatgaaaacctactggaattgctttagctagtgaaaattatcctgagatggtttcaatctttcaaatcatttgtcaaaactgctgaccttgactcccatccctttatgcccttctaaagtgttgtttgtgg

SEQ ID NO: 99466 - DNA, 433 bp, Homo sapiens
agggtaatggtgaggacccagttaagaactgacatcaagtgctgtaagcaagtactagagagcttaccagctgcctccccgttgttgttatcaccggcccctcattccatatgtaagtaaatatgggggcatacaacgtgctgcccatcgtcgcacagccagttagcagcccaaagcggctagaagcactaatgactgcctgctctgaggctactgctttgcaggggaaaaccgaggtccctgggtcattcaggtggcaagtgaccatcccatatctgcttgactccagcccacgctcctcctgtacaggtacgccacctgcggcacacggagggcacagccttcttgtcagcgttatgcttacttattcaagatgatgccctgtaactacaagttacacgctcacatacacataaaatgtaatatcatccaa

SEQ ID NO: 99467 - DNA, 599 bp, Homo sapiens
  misc_feature (13)..(13): n is a, c, g, or t
acccttcaaaggnttttgtaaacaggtagttcatgcgtactatacggtctagtacagctggtgcatcggacgaggccgcatgaactctttctacaacagtttgtgaaaaatgcgcctttcgggtactgtgagcggcgtgcgggtaggagcgaactgcaggatctcttggtctccccgcccagaggttgtcgagggcagcctgctggggagagcgggaggtaccaggcatgcgctggggcggtggctccgcacccgagtccctgcaccctccgccacctgcaggccactcaggatatccaaagcgatccacatctccggccctcagcccccacccctgccgcccccgcgcttcctgaggctgtggctcccctggaggaatcgcccagtgaagacgggtgctcccagatgtcaccgcctcgtgttcccttggccgccttgcggggaagtcttagggttgaaaatccaggtctgcaatgaatgcattccacagatggtgtgtagggctactgcatgcccagcacggttctaggcggggagcaaaacggtaagtgagacacaaatcccaagccacgtggagaaagtgaccagccagtagatgc

SEQ ID NO: 99468 - DNA, 344 bp, Homo sapiens
agtgcctgccccaattctgttgtcacaggctgacctgctgaccagcacagagattcctgacaatgggttgcacatgcatgcaaacctgcagacctctgggatgcttgctgcggactccctcatcccaaccctctccccttctctcctgttccacattaattctgcactgtagaattttggtgttgatggtggttaccaatagcaacttcagtatccttcaagtatgatatgtagaggaaaccttgttgggaaaacagaggagtgctttctctcctctgtttaagtttcttttggttgcaagcaacagaaaccaactctggctagctctagccaaaaataataat

SEQ ID NO: 99469 - DNA, 451 bp, Homo sapiens
aatcacttgaacccaggaggaggaggttgcagtgagctgagatcacgtctcttatatagaacctagtttgaaaaggaagggatattttaagtcttttaagataatgttaactatttttctttctttagctctatttctgtgtgtagctgttttactacaccagaattcagcaagttatagtttcttaagagttagttgctttgtggaaattgaagccctatcagtaaccttttcctcctcgtgtatcttcaaatctattaccgagccttaaactttgaatggatcttgtatccctagcttattcaagggttaagaaaatacgttttctgtaggaaaagaagacatgttctgtggctcatccagagtattatttgagctgcatgtctatagttttaatcacatactattgggaggtcttcctggggagatgctggaggcccaggagtcaagg

SEQ ID NO: 99470 - DNA, 405 bp, Homo sapiens
tggagtgagaacacatcactaatgggacaatcacatggggtctcttggcagctccactggaaacatacagatttcgatattctgggccactggtgagtgacaactgttttatggcacagactagcaattatgcaaatattcatcctgctctttggaattaatagttatttcccagacaccccaggtacacatgatgtgaagagttaaatcttaatactatcccatgggcagataggccactctagttctagctaagtgttgcccagtggagccagtggcagaatagtatatgccttagaaacttccattctatagaactagaaaaaagatttaaagttgctcctgagactataagtcctacaactactaaatcatgtactgtctgaacactgacagggcactgtg

SEQ ID NO: 99471 - DNA, 432 bp, Homo sapiens
cagcagctgagctaagaagtgtggctaagaagttttaaggaaatgttattaggaatgacttctaattcataaaagattttctgaccaaatatctgctatgttaacattgctttggagcaggttccttttatcagttgcactatccccactagtgatcagtcttattgcagtcagagatgcagtaaacatcaagacccaatttaactagcaatggcaaaatagcaaataatcatgagtttgggggcttcgggccataaaatacagacatttaccttgaatgtagatttaaaccatctatatgttgtgctaaatgaaacttggaatatctcatctgaagttcggtgtccaaatgataaaaatagtcctgaaaactttacctgtgtgttaaaaagaggcttcaaagggtatggttctcttagagtgaggcagttt

SEQ ID NO: 99472 - DNA, 358 bp, Homo sapiens
tgccaccctactgacacttatgtatatccttaatgcccagttgttggtgcctaatagtgtttaccattaaaataaccaggagttcttggagggtagctgattacatttcttgagacaagaaaaatcaggatgggtctatagcatcctgttcattccagaaagtaaggatattttcaaggatattggggtagtggtacaaagacaaaggtgataataatttttttttgaggcggagttttgctcttgttgcccaggctgtagtgcaatagagcctcttgcctcactgcaatctctaggttcaagtgattctcctgcctcagcctcccgagtagctgggattacaggcgcccaccaccac

SEQ ID NO: 99473 - DNA, 252 bp, Homo sapiens
gaatgagctggtacggggatcttaagtgactgaggataagcttggatggcgtcgtttacaagttgtgactgggaggtggcagaaaggtaaggggtgaggccagtcatatgtgtggaatatgtgatgcacagccctgtactttggctgtgtgtaatgaaaagggttgggatgagttagggagagctagtgtgggggcagcttctagggctgtttttaaggaacagaaagaggagtggtgaaaggatttaggat

SEQ ID NO: 99474 - DNA, 175 bp, Homo sapiens
tcgagagtcgaccggaggtttgaatctgtggacctggccgacgcttgaacaccgtcgggatggggaggatgctagtatgactacacaattcttaccaggggaggagcgcacttgtataactactataattttttctttttcttttctttttttggtttcgtttgtttgtttttga

SEQ ID NO: 99475 - DNA, 470 bp, Homo sapiens
gattatatgaagggagtgggtgcaggagacaaaactgattacaatgaaaatgggagccatgagttcccatctgcagctccaacgtaagatgcctgcagatgtggtcggtgtggcatgtgcagcagggaggtgaagaagaatgggttgggcagggagagtgctccttgagagagcagtcagcctgctggccttcacttcttggccttgccctgggcagccacagcttccatggctttatgaatggtctcttcatccccaggaactttttttattcatgggcttgatgggcttcaagttcttgtccaatttatagaccatgggattaccagttggcaagttcagctccactgtggtctcttcagagagactctccggcagcttttaactgacaatatcttcatttctcccctttacttttgaaagaattttctcagatatagaattcttagttgacagttttcttctcttgc

SEQ ID NO: 99476 - DNA, 387 bp, Homo sapiens
ttacaagtgtgagccaccgtgcccagcccatgaacagactattacgggtgatttctagtgaggctccaaaagaaaagaggagatttgaaatcctcaaccagaatgttggtaaaaatgtgaacagtaaagctattcttatgaggtcccagatggaaatgagaaacgtgtggtgggcaatggaggaaaggccatccttcttatagtggcaaatcacttggctgaactgtgcttatgtattagtgttttgtggaaggtagaacttacgggccactgcaattggatatttggctgcagaaatatctaagcaaggttttgaaggtgcagcttgtgaaatgtgaaaagagagaagtgatttaaagatgggattgttacttaaaagggaagcag

SEQ ID NO: 99477 - DNA, 227 bp, Homo sapiens
tgtcacccaggctggagtgcagtggcacggtcatggtctctgtctcctgggttcaggtgaccctcctgccttggatcctttcaaagtgctgggattacaggcatgcaccactatgcctggctccttattttcttttttgcttgaggtgttttgctgtcctttttgctgggtgctgtgtggtcatcgcagtctgaatttgattttgtgaaaatggaagagctcgggag

SEQ ID NO: 99478 - DNA, 543 bp, Homo sapiens
gcccaagacggcaaggacaggaggcatcaatcccacgggtaggtcactggtgtgatagtgagaagggcttttgtactctcacaccaggtccccagctttaggagactttgaagacatagtattatacaccgcccatagtattatacatcacccactgtccactgaatttactacagactggaggacggctccctgggaggtagtgtcccccactggaacttggctgagcctctaaaaggctgtgctctgttccatcaggttggctgcttctgaatgatgggcttcatggtaaagctgatgaatcccacggccttgaacccattatgttaagttccttgctgagaatgggtcccttgttccagctgaaggtttgtgggatcccaactcaatgaataaggtttttctgtaagcccttagatgataatgcagacagaaacatcatgggccttcgaaggcaaccccatatctagaggatgttttgatcatgataagcatgaattgttgttctttgcagggtggaaaggtctcagtgtaagtgaccca

SEQ ID NO: 99479 - DNA, 341 bp, Homo sapiens
ctcccaggtgcaagcgattctcctgcctcagcctcccaagtggctgggattaccggtgcatgccaccacgcccagttaacttttttgtatttttagtagagcggggggtctcgagtcctgacctccgatgatcccacccgcctgagcctcccaaagtgtgggattacaggcatgagccactgcacccggtgatctgtcagccactttccttgtcctctacagctaatcacccagttctgtgcctgtgttttacacacaaaaacctgcacatatttatagcagctttatttataattgccaaaagttggaagcaaccatgatgtacctcagttgatgaatgg

SEQ ID NO: 99480 - DNA, 988 bp, Homo sapiens
tccagccccagccgggccccctcgcgccgctgcggctgctgcgcggtgaggtcgtgacaagtcacagctaacttgccctccgcgccattccacgccaccaggaagcgcagccggtgcctctcggcatcggcgaagaggccttgccggaccggcgcccagccctccaggctgtcgagctgctcgtcctccatggccgtcggcggcagcggccctaggactcggcgggcgcgggcctgacctcgtcgcactgcctgtcaggggacagtcccaggctggagtgcaatggcatgatctcggctcactgcgacctctgcctcttgggttcaagcgattttcttgcctcagccttcgcagtagctgggattacaggcataactgaaggtgaaaggacagaatcaccgtgtgttactggcacagatgcatcggctagtgaagaaagaagacattcaaactagtcccgctctgtcgcccagtctggagtgcagcagcgccatcatagctcactgccacctagaagccggggtgaagcaatcctcctccatcagccttcagagtagctgggactgcctgcgcggcccaccacacccggctaatctttgtggtttttgtttagttttccgttctgggtttccgtcgggcgcagtggctcaggcctgcaatcccagcactttggaaggcagaggtgggcggatcacccgaggtcggagaccagcctgaccaacatgaagaaatcccgtctctactaaaaaaaagaaacaaactacaaaattagccggatatggtggctcatgcctgtaatcccagctactagggaggcccaggcaggagaatcacctaaatccgggaggccgaggttgcggtgggcaaagatcacaccattgcactccagcctggacaacaagggtgaaactccatctcaaaacagagaccgggtttcaccatgttgcccaggcggtctggaactcctaggctcaagcgatctgccaca

SEQ ID NO: 99481 - DNA, 890 bp, Homo sapiens
tccagccccagccgggccccctcgcgccgctgcggctgctgcgcggtgaggtcgtgacaagtcacagctaacttgccctccgcgccattccacgccaccaggaagcgcagccggtgcctctcggcatcggcgaagaggccttgccggaccggcgcccagccctccaggctgtcgagctgctcgtcctccatggccgtcggcggcagcggccctaggactcggcgggcgcgggcctgacctcgtcgcactgcctgtcaggggacagtcccaggcataactgaaggtgaaaggacagaatcaccgtgtgttactggcacagatgcatcggctagtgaagaaagaagacattcaaactagtcccgctctgtcgcccagtctggagtgcagcagcgccatcatagctcactgccacctagaagccggggtgaagcaatcctcctccatcagccttcagagtagctgggactgcctgcgcggcccaccacacccggctaatctttgtggtttttgtttagttttccgttctgggtttccgtcgggcgcagtggctcaggcctgcaatcccagcactttggaaggcagaggtgggcggatcacccgaggtcggagaccagcctgaccaacatgaagaaatcccgtctctactaaaaaaaagaaacaaactacaaaattagccggatatggtggctcatgcctgtaatcccagctactagggaggcccaggcaggagaatcacctaaatccgggaggccgaggttgcggtgggcaaagatcacaccattgcactccagcctggacaacaagggtgaaactccatctcaaaacagagaccgggtttcaccatgttgcccaggcggtctggaactcctaggctcaagcgatctgccaca

SEQ ID NO: 99482 - DNA, 414 bp, Homo sapiens
ggaacaaatcccagtggtagtgttacttggtgctctgtgactttggaacctaaagcttcactagaccgttgcaattactaagtgagtaaataaagcacatagcacaaaggcctggcactgagatgcccaccctcttcatggggctcctgtcttcttccttcctgatagatcatgtgtaagttcatatgtatctataagggacatgaattatccagaattccttatagtcagaatgtacagtgatataatgttcctgagttacttacccatttccactgggtaagtcagcttgcagaactcatttccgtttctcttcaactagccaaacatccattttcacctacatggaaacttctactggccttgggacaaataaatcacatttggagtgtcccaggacaatttagctttaga

SEQ ID NO: 99483 - DNA, 660 bp, Homo sapiens
ttcaactgaccaaccctgcgtgagcagttcactgaaaatgtggccatcagggctggcgcttaagtgactgaatgaattaaatctgtgacccccactgtctcactgactacttatctgagcaactatctgagcaggctgaactaaggcctgcctgagaatgggcagtgtttaaatgaagcctattgaataacttggaagtcacacctcatgagaagggtactcgaatttaatgagacacagcgtgtgttcagtcatgcgtgaatactgtattacagagaagtgtaaacagaactgctagtaacttgagcggggggatacctggctctaactaacagcatgggaggcttcctgatcacctgaaacaatcaagacatagcaaaaggccaagagtacaaaatcattttacatctgaggcaaacattagtatttcagacctttaaaataagcattttagtattacagcagcagaattagaacctgggtgggggcggatgaaaatttaaaggagagagttatcatccaagccaagtataaagatgcgccttttccaggggaaaagaaacagaaggcaatgatgtgggacctgtaacttaggtgtaaagagacacagaaaaattcaaacctctgaggtataaatctgagaagtttaacaaaaaaaaa

SEQ ID NO: 99484 - DNA, 564 bp, Homo sapiens
tcatatctactgcctgcaaaagaggcatcaataagaagctctctaaaagacttagaatcctgaggcacctctgaaagctggatgtgggtggggtcgaaacagttgcctggtatgtcaagaagagatggcttgtaatcatcttctattcataagaaccatttgaaatatgtcattaccataaattcaaatggtaccaggtaaggcattagtttactcttccaccttcccatccatgtcagctgttgtgtacatgcacaagtacacttctctgctttgagactgtcatcagaaatagatgactcctatcccctaacagcagaaatagtaaacagcatgatttactaaaacactacaagataatcactgctagattataaaatgttcaaaagtctaccttatgctaaatactgatattcaggccaggggtggtagctcatgcctgtaatcccaacactttgggaggccaaggtaggagggtcactttaactcaggagttcgaaaccagcctgggcaacatagtgggaccatcatctctacaaaaaaatttaaaaattagctgggcgt

SEQ ID NO: 99485 - DNA, 236 bp, Homo sapiens
ctgagtagctgggaccataggcgcctccatgcccagctaattattaaactttgtcttgagacggagtctccccacgttgcccaggctggtgttgaactcctggctcaagcaaccctcccacctcggcctcccagagtgctgcaatgacaggcatgagccccggtgcccggccttcttttgtattaactggaattcgtgtgcaaaggctgctggcctcctccccttccttttttttt

SEQ ID NO: 99486 - DNA, 626 bp, Homo sapiens
gcctggccgtctcctaggttagtgtagcagagattctattctcagataagacttccgtgtcggctgaagatgtaagggactgtccacgtttgagggagaatttcttctcactattctagctagaatatgtgaatgaagaaagatttctattatcctggactcctttgtattttttataattgttttctttttctcacttatgctctgatatgtattggtttcttgaataaattaaaacttaaagcactgctttagtagacatttctggaattcctgtctcccgctttcctgaccacatacagctcttctccactgcctacagctgtatgttttagcatgatgatggatggatggactggagctagagcaaggttaaccacatatgctctggtttcagaaacatcagagagggaggtggtgacatttataagtattcatcttttatttacaaatttcacgcacatttgtagtctactgtaagcaacatagtgtcttctaccatctttttcctcttaagggtcaacactactattctatttcatatttaccatttttttcttttaaaagaattcatgtggtgggtcattgtagaaaatttagagaatatgcaaatattgaaaaaaaaa

SEQ ID NO: 99487 - DNA, 403 bp, Homo sapiens
aaggtgtgactttcattaatccctcctggatccagggaagacctgaaaagggaatccctggctgtattaatggagattcactacagatgcaaattttccccacaagaggtggctttgcagggccatttcaaaatatgccaggaattcagtttttctgatttctctggggtgcctttggtcaaagcagggtccattcagtcacttgaggggcttatgattttattctgggtttacacaatcttaagtcaaaatagaaaataaggaaaaaagccagacgcggtggctcactcctataatctcagcatttcgggaggccgaggtgggtggatcacctgaggtcagaagttccaggccagcctggccaacataatgaaaccccatctctactaataatacaaaaatt

SEQ ID NO: 99488 - DNA, 509 bp, Homo sapiens
gccccctttagactatgaatgaaccccaagttctgctccgtttccttacacctggccccatttcccacactctgtctgtccctgtgaacacctcagcttgcaaccctagcctaagcttccaaaggggaaggcgtcactccttccaaatcaaaacagaactcgaagagactgaagcctgggttttgtagcgcaaccacaaacccccgtttgttcaggacagttgggttcgcatgtgttgacctggtgtcattattaatagcgttccctttcactctcactgtcctgtcaggctgccttgagtctctgccggctctagacccacctgtcataccaaggattctgtacccagagccctcagaaggtcatttgctctctgcatagtttctcagcctggagatttcaaacttcctcctagcagagtttattctgcagcatgctgctaaggtaggcagaagtaaagagagaacggtggaataaagagaagttagaaaaaagaagagagctaaagg

SEQ ID NO: 99489 - DNA, 699 bp, Homo sapiens
tataggtgcaggctgccatgcccggctaatttttttatttttgtagaaatggggattcaccatgttgcccaggctggtctcgaactcctgggctcaagcaatatgcccgcctcggccttccaaaatgttgggattacaggcgtgcaggccagggcttgcactgtgagctccctgaaagcaaaaatcatgtccagctgacctctgtgtccccagcatccagcctttgctgctcagagaatgttacatggaggttcctgcaccaggtgagggactgagcaagagtcttagttttggggttggttttagccatggtgctgtatctttaaatgaaatcttccaaagagacaatacataacgcaggtgaaagaggagctggtctcatccaagtcaggacaggagctgatctacagcttccaatcccactcagaaaccccatctgcccccaagggggtctgtggaaccaccagtgggtgctctgaggaaccgagtacgtaaactgtagatgcggtggagagcacaagctggagcctgggagaggcagaggtgagccccaggccagtccctgatttctgggtggacttggcccaggccccagtgctgggtcctccctcactggctcacaaggtaggtcaggtcagaggaggtcagggggtgacagatgggtctatcctatgggtgggccaggcgtggtggctcaca

SEQ ID NO: 99490 - DNA, 632 bp, Homo sapiens
attttctggtagtccaagtggcctggtaatgcaaccactggccaagcagcagggagcacttgggccctggaggcgtgcaggccagggcttgcactgtgagctccctgaaagcaaaaatcatgtccagctgacctctgtgtccccagcatccagcctttgctgctcagagaatgttacatggaggttcctgcaccaggtgagggactgagcaagagtcttagttttggggttggttttagccatggtgctgtatctttaaatgaaatcttccaaagagacaatacataacgcaggtgaaagaggagctggtctcatccaagtcaggacaggagctgatctacagcttccaatcccactcagaaaccccatctgcccccaagggggtctgtggaaccaccagtgggtgctctgaggaaccgagtacgtaaactgtagatgcggtggagagcacaagctggagcctgggagaggcagaggtgagccccaggccagtccctgatttctgggtggacttggcccaggccccagtgctgggtcctccctcactggctcacaaggtaggtcaggtcagaggaggtcagggggtgacagatgggtctatcctatgggtgggccaggcgtggtggctcaca

SEQ ID NO: 99491 - DNA, 2600 bp, Homo sapiens
cttgtccggtgacctaggagcaggcctcctggtcaacagccccacagaccaatggctgcacctcagaagaggactgaatagcgggtgttgcccccgagtgctcagagtccctagggaagctcacacctgcgcaaccttgtccagagtcccctgtgtatcctgccggcacctcctccagggagcctctgagtcttgcctagttgagcagcagcccccatccctgtcctccacagccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtatgatgcgttcaccaagtctttatttccgaagtgctgttggctctattggcctcagtgaactgggtggggtcggaaagattgtacccccttgacaggtgggatgactgaggccctgagaggggtagggattggtgggcatctctgtgctgggtcctctggaccacatgatagctggggggtactgacctgcaaggaatcctgagctcctgggcagagcacctagttggatggacaactattgctctcccactccatgagcccctgggctctcaccagcatcctctgcctccccaggatagctcctccttggaaatctggccttagagaggcagtcagtgtgggcagggctttggcgaccccaccaattctacacacggatggaggaaaggcctgcttcaccacacacctatactaccctgcccgtcccagagaaaagcaagggttttctgcccacctgcctttgtgaacattcactgagcacctattagatattagg

SEQ ID NO: 99492 - DNA, 2601 bp, Homo sapiens
  misc_feature (1784)..(1784): n is a, c, g, or t
  misc_feature (1787)..(1787): n is a, c, g, or t
  misc_feature (1798)..(1798): n is a, c, g, or t
  misc_feature (1815)..(1815): n is a, c, g, or t
  misc_feature (1831)..(1831): n is a, c, g, or t
  misc_feature (1842)..(1842): n is a, c, g, or t
  misc_feature (1856)..(1856): n is a, c, g, or t
  misc_feature (1861)..(1861): n is a, c, g, or t
cttgtccggtgacctaggagcaggcctcctggtcaacagccccacagaccaatggctgcacctcagaagaggactgaatagcgggtgttgcccccgagtgctcagagtccctagggaagctcacacctgcgcaaccttgtccagagtcccctgtgtatcctgccggcacctcctccagggagcctctgagtcttgcctagttgagcagcagcccccatccctgtcctccacagccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgatgaacanaanaaaaaagttanaaaaaaaaaacaaaacnaaaaaaaaaaccgaanccaaataaaangaaaaaggaagganaacangcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtatgatgcgttcaccaagtctttatttccgaagtgctgttggctctattggcctcagtgaactgggtggggtcggaaagattgtacccccttgacaggtgggatgactgaggccctgagaggggtagggattggtgggcatctctgtgctgggtcctctggaccacatgatagctggggggtactgacctgcaaggaatcctgagctcctgggcagagcacctagttggatggacaactattgctctcccactccatgagcccctgggctctcaccagcatcctctgcctccccaggatagctcctccttggaaatctggccttagagaggcagtcagtgtgggcagggctttggcgaccccaccaattctacacacggatggaggaaaggcctgcttcaccacacacctatactaccctgcccgtcccagagaaaagcaagggttttctgcccacctgcctttgtgaacattcactgagcacctattagatattagg

SEQ ID NO: 99493 - DNA, 300 bp, Homo sapiens
ctgtggaatctggaatcccatcatgttagactcagaggccctgagagacatccttatccagcagcctcatttacagaccaggaaactgaggcccggaaagaaggggccagttatggtgacagaggggttgggtcagagcccagactggatgggcagagggcagtggagctgggtccagatttagacccagcattttctaagagctcctgttcccgggtgttctaggcaggtgctgccacacgagagggaggtggccggcgccctcatgaccttcttcctggccctgggactttcctgtgg

SEQ ID NO: 99494 - DNA, 614 bp, Homo sapiens
gagaggggagttggagaccagtatgagctgcagccgtttccctcccaggtcagttcttcaaccccatctgctgcttcctcctcttcaacatcatggactggctgggacggagcctgacctcttacttcctgtgggtaagcacaccagggctgggtgatccgatgttttaggaagcagtttgggatccgagggcttgaaagagcatggaggtgattttctggtagtccaagtggcctggtaatgcaaccactggccaagcagcagggagcacttgggccctggaggcgtgcaggccagggcttgcactgtgagctccctgaaagcaaaaatcatgtccagctgacctctgtgtccccagcatccagcctttgctgctcagagaatgttacatggaggttcctgcaccaggtgagggactgagcaagagtcttagttttggggttggttttagccatggtgctgtatctttaaatgaaatcttccaaagagacaatacataacgcaggtgaaagaggagctggtctcatccaagtcaggacaggagctgatctacagcttccaatcccactcagaaaccccatctgcccccaagggggtctgtggaaccaccagtg

SEQ ID NO: 99495 - DNA, 968 bp, Homo sapiens
cttgtccggtgacctaggagcaggcctcctggtcaacagccccacagaccaatggctgcacctcagaagaggactgaatagcgggtgttgcccccgagtgctcagagtccctagggaagctcacacctgcgcaaccttgtccagagtcccctgtgtatcctgccggcacctcctccagggagcctctgagtcttgcctagttgagcagcagcccccatccctgtcctccacagccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctggtaagccctgagaccctcctggggaggtgggagatgcagaggaagctagagccacctcccctgggaagctgttccatctgttcccagccagagcccacccctagtagccttgtgcaaacaggaagatcatgaagggaagttggtaggattaaagtcatccctgctgttgtttgggcctcagtttccacctctataaaatggggaggcgacagaggttccatgcatgcaaactttggatccgaagacctctgaattggaatactagtttcacaacatcccagctgtgtggcctgagacaaaccacttagccactgcacccctctgaacctcaatgtgtcatttgtaaagcaatggtaatgagataatccatctaaggtgcttcgctcatcacccgacccatgcacgcgcttcctggta

SEQ ID NO: 99496 - DNA, 1898 bp, Homo sapiens
ggctacctgtgcgactccagccgccctgcaccggaatctggggagacccgccccccgccccaccggtctgcggccctccgccccagcgcaggtgcaggtgcggcttctctgcccctttcaccccaggcgcatccgcggcggcggccatggcgcgaggagacgccccgcgggacagccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtatgatgcgttcaccaagtctttatttccgaagtgctgttggctctattggcctcagtgaactgggtggggtcggaaagattgtacccccttgacaggtgggatgactgaggccctgagaggggtagggattggtgggcatctctgtgctgggtcctctggaccacatgatagctggggggtactgacctgcaaggaatcctgagctcctgggcagagcacctagttggatggacaactattgctctcccactccatgagcccctgggctctcaccagcatcctctgcctccccaggatagctcctccttggaaatctggccttagagaggcagtcagtgtgggcagggctttggcgaccccaccaattctacacacggatggaggaaaggcctgcttcaccacacacctatactaccctgcccgtcccagagaaaagcaagggttttctgcccacctgcctttgtgaacattcactgagcacctattagatattagg

SEQ ID NO: 99497 - DNA, 467 bp, Homo sapiens
gcccccttcctctacctttaaagtcagcatttgcgggttgcatctctctctgacccgtcctccaacgttgcccgctctctgcagctagaaaggttctgtgttcttaagggctgaagtgattagattgggcccaccccagataatccaggataatctccccatctcaaggtctgtattcttagttacatctgcaaaatcgctttggccacgtaaagtaatatattcacaggttccagggattagggcatgaacatttttcggtgggtccactctttttgagatggagtctcgctctgtcacccaggctggagtgcagtggcatgatctcggctcactgcaacttctgcttcctgggttcaaatgattcttgtgcctcagcctcttgagtagctgggattacaggcatgagccactgtgcccagtgggtctactcttttgcctactgcggatgccttcttgggcagccc

SEQ ID NO: 99498 - DNA, 1056 bp, Homo sapiens
tgtttccttgcttcccaagggggtggtgtggaggggaagggggaatgatttttcttgcgtctcccggaagctgtgctgttagacacaattacctcagctaggtcactgagaccaaatcatacgggacgcttaatgaaggaccgcattcaaaagggattacgccttgaagtgtcctggcgggcgacatttttacagattttaaggggcaaatttagaacagctaaaaaaaaggtttcaaagccgtgactactaaaagagcatctaggcctcccattttatcaggaggaattcaacttagaaaatgcaggtagtgtcatacaaactgaaatggagatacaatcctgatagaagattacacaagataccaggcattattgtgtcaaattagcactgatgatttacccatagcagtatgaacttcttggaggaaggaaagaaaagtacaacagcttcttcagagaaaagaacaaattggcataggaaagaagaaagacacttcgtttaaagaatgtattttgcagtaaatgcccacaaacagcccatagagagttcacttatttatgcatcaccatatgattattctgactgcctttagtctcaaacagggaaagcctccgcaaaaagcattctccaggtgttagtttaggtttgtcattatttcctatttatagactctgtctagtaaaagaagacaaattactgtaagtgggggtaaatgtgattaaacgagtcctctgaagataagaagttacatggacaagggtcattaacacaaatgacctctttttgccagaacatatttttttaatttagtggatttgaaaaaaactgcaaagcaagaataatctctactgcacatactcacagagaaacatatcccttttattctaataaatattttcatgactcttcagtattttaataacatactgataatgccaaaatactctcagaatacaccaagaacaatattggagggatcatttatcttaaggagtctaatcggaaacacttaagcaacatagttataatcagacaagacatataacaccaaga

SEQ ID NO: 99499 - DNA, 1281 bp, Homo sapiens
tgtttccttgcttcccaagggggtggtgtggaggggaagggggaatgatttttcttgcgtctcccggaagctgtgctgttagacacaattacctcagctaggtcactgagaccaaatcatacgggacgcttaatgaaggaccgcattcaaaagggattacgccttgaagtgtcctggcgggcgacatttttacagattttaaggggcaaatttagaacagctaaaaaaaaggtttcaaagccgtgactactaaaagagcatctaggcctcccattttatcaggaggaattcaacttagaaaatgcagagacagagaaaacctgttgtatgatccagtattcctggttgtattttttttaaagatgggcacagaacacagaagttagcatactagccatgtcaacaaatacaatgacctgtgccacggtgatatgatatgaagcagttaatgcaacagataaaaattgcatttgacccaaatgtaacagttcaagattcatgatcagaagaaatatgtaactaattcacaaaggtagtgtcatacaaactgaaatggagatacaatcctgatagaagattacacaagataccaggcattattgtgtcaaattagcactgatgatttacccatagcagtatgaacttcttggaggaaggaaagaaaagtacaacagcttcttcagagaaaagaacaaattggcataggaaagaagaaagacacttcgtttaaagaatgtattttgcagtaaatgcccacaaacagcccatagagagttcacttatttatgcatcaccatatgattattctgactgcctttagtctcaaacagggaaagcctccgcaaaaagcattctccaggtgttagtttaggtttgtcattatttcctatttatagactctgtctagtaaaagaagacaaattactgtaagtgggggtaaatgtgattaaacgagtcctctgaagataagaagttacatggacaagggtcattaacacaaatgacctctttttgccagaacatatttttttaatttagtggatttgaaaaaaactgcaaagcaagaataatctctactgcacatactcacagagaaacatatcccttttattctaataaatattttcatgactcttcagtattttaataacatactgataatgccaaaatactctcagaatacaccaagaacaatattggagggatcatttatcttaaggagtctaatcggaaacacttaagcaacatagttataatcagacaagacatataacaccaaga

SEQ ID NO: 99500 - DNA, 171 bp, Homo sapiens
gtgtactaccatctttcaatgatgattcaattcctcatattagatctgttgtcttcaaaagctgttttttattaattttatttatttatttatttatttagagacagaatcttgctctgtcacccaggctggagtgcagtggcatgatctcggctcactgcaacctccacc

SEQ ID NO: 99501 - DNA, 1344 bp, Homo sapiens
atgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcagcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgccaaaaatctcaatt

SEQ ID NO: 99502 - DNA, 257 bp, Homo sapiens
gcacgaggaagtgatttcacaccatatatcatgtgctgtaaaagaataaccgctcaggttgagtgtaaaaatattttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgccaaaaatctcaatt

SEQ ID NO: 99503 - DNA, 979 bp, Homo sapiens
gccctggaagctattactgcaagaagccacaagcattccactgacttagaattagcagtggcagaaatgctactttttatcataatgcttccttcttgctttcctacttaaaacaagctgagttactaagtggtaaccatagttcattaaaggcatggagaaacttcaggatatcgttttaaaagacaaaacaactttctagtcagtgacaggtgaggtaggtgtagattccttggtgtcaaaaggaattatgaatgacagcagtaaacatgaattatgaatgacagggtaaacaagatcaaaccctttacagattacaccttcctgtagcagtgaaaaattcagaatcttatttaaaaataacatgcatgctatgaccttcccactatgcagttatcacaaataattatcttttatttcacagcagcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgccaaaaatctcaatt

SEQ ID NO: 99504 - DNA, 1351 bp, Homo sapiens
ccgactgcaaaggaccctcgggagggagcgcggcgaaaggggcacccgtaggagcccgggcgagctgtttcccgcccgactccccactccctgggggctaccgcgtggggcccgggtgcgctgggggccgcaggtgctggcggcacaaacgcgacggtccctctcccgccccggcccgcaggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcagcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgatgggaccataaaatatttttacactcaacctgagcggttattcttgacactcttaacagaattttttcaattggttgtcgtgaccttagagtacgtcaatgcactccaaccagagttccagtctgatttgccatcacccctttaaaatcacgtta

SEQ ID NO: 99505 - DNA, 384 bp, Homo sapiens
cctgaattgctcaaaaaagaaagcatcactaactcttatgctcactttcagatttacaatgtccattacaccatgagtatcaatgggaaattacaagatgggtcaatggaaatagacgctgggaacaacttggagacctttaaaatgggaagtggagctgaagaagcaattgcagttaatgatttccagaatgtaagtatatttcatgcatttagagaatttaaccaggcaagcctgcgggacttttctaattcaaggaggagcagcgtttctcacacacatccaaatggtaactgttctttatagcagttgtagtgccactaatccactacatgtagcatattctctctgagaaaggaccagactttgtccttcatatttgca

SEQ ID NO: 99506 - DNA, 1453 bp, Homo sapiens
ccgactgcaaaggaccctcgggagggagcgcggcgaaaggggcacccgtaggagcccgggcgagctgtttcccgcccgactccccactccctgggggctaccgcgtggggcccgggtgcgctgggggccgcaggtgctggcggcacaaacgcgacggtccctctcccgccccggcccgcaggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcagcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgatgggaccataaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgccaaaaatctcaatt

SEQ ID NO: 99507 - DNA, 380 bp, Homo sapiens
taccatttcctagcagcgcaactacttctcagattagcatggaaaggcctcccagactagcccgtaccctccaacagccaggtgagtcaggccaagacgtgggttccctgaggaagattcccgctggaaatttcagggaagaacctcacctccttccctttcttccttatttggtagttgtcctaattgtaacaagcatccaagttacaattcaagaccaagtagggacctgaggtgatctcctgtcctgtctgaaatccaccttcctttcctagctgttcccgccagatttcagcgccctcttcccttctcctcccaagacagtcttagctcagacaggatttccttagtcttagtcatcagctcttattgtccggcct

SEQ ID NO: 99508 - DNA, 2073 bp, Homo sapiens
gaatccacccgcggaaactccgagcccctccgactgagcatgcgccatcgccaggcggcttttggtcacaggctcccgagttctcctagctggggctgcggagctggggggagggaagagaggaaaggggagggggtgcctggagaggcggaggctcgcgcgcctgcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgacaaaaaaaaaaa

SEQ ID NO: 99509 - DNA, 2002 bp, Homo sapiens
gaatccacccgcggaaactccgagcccctccgactgagcatgcgccatcgccaggcggcttttggtcacaggctcccgagttctcctagctggggctgcggagctggggggagggaagagaggaaaggggagggggtgcctggagaggcggaggctcgcgcgcctgcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaatttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgacaaaaaaaaaaa

SEQ ID NO: 99510 - DNA, 1215 bp, Homo sapiens
cgtctaacattaattcagagggtatgatttttactaagatcacagaagcaggaagatgagaactccttaagaatacataaaaaggtatctctaagattagagagatggagaacagaatagtgctgccctggggttagggagcaggagagactgtggcaataaatgtacagcagattctatatcctgattgtggtggtggtcacattaatccacacaagtgatgaaactgcagagaactacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgacaaaaaaaaaaa

SEQ ID NO: 99511 - DNA, 448 bp, Homo sapiens
gcgtggtcgcggacgaggtacgcggaggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacacccaagattttgatttatttggtttgaagtgtgatctgaacagcgagttcttaaaagctacccaggtcattccaatccatggctacctttgagaaccacc

SEQ ID NO: 99512 - DNA, 377 bp, Homo sapiens
gaatccacccgcggaaactccgagcccctccgactgagcatgcgccatcgccaggcggcttttggtcacaggctcccgagttctcctagctggggctgcggagctggggggagggaagagaggaaaggggagggggtgcctggagaggcggaggctcgcgcgcctgcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaa

SEQ ID NO: 99513 - DNA, 1916 bp, Homo sapiens
tacggaaatgtcagctgccggatgcacgccgtgaaagtttcttggcagggcagggaaggaatgtatacccggaagacgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgacaaaaaaaaaaa

SEQ ID NO: 99514 - DNA, 1862 bp, Homo sapiens
cagcggacggatgatacctagcgagtggtggaaaaaatcggcgcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgacaaaaaaaaaaa

SEQ ID NO: 99515 - DNA, 1815 bp, Homo sapiens
ctttctaaggttgtgactgggataacctggcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgacaaaaaaaaaaa

SEQ ID NO: 99516 - DNA, 1862 bp, Homo sapiens
tacggaaatgtcagctgccggatgcacgccgtgaaagtttcttggcagggcagggaaggaatgtatacccggaagacgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaagcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgacaaaaaaaaaaa

SEQ ID NO: 99517 - DNA, 1694 bp, Homo sapiens
agcggaagagaccgtgcgcagcgctgtaactgacttactggattatttccaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgacaaaaaaaaaaa

SEQ ID NO: 99518 - DNA, 107 bp, Homo sapiens
actgagctatgaaaccgtgacaagtgcatggagcagctatttgagcaccaggaaaggaaacgatacgcagcagtttgggatgaccccagcagatgaaatacaacaga

SEQ ID NO: 99519 - DNA, 485 bp, Homo sapiens
actagggttttgaagaatgagcagaagctctgcgtcagatgaagaagagacaggaggccctccaagcaaaggaaccactcatgtcaagacatggggcaaaaagagaggatgtatttggagaacagagagtaaccgaaggctatcattcaatcagtgatagtcttcatggaggttaatatcaaaggcaacctgaatttcctcagacttcatgagctggcggtgaagggtgagatcacacaagcagtaataacccagctctccctggctcactgccttacttactggccttctggtactcagcaaagctgtccccatgagtttgggagtctccattcctgtccttccactcccctcaaacgtctttcattcaaggtcacgtggtaacttgactcctctcaccactacttctgtgggaatgcagaggccaggccagagcctgtgggtgctgccctccccagagacttcactatgcccagctccaggga

SEQ ID NO: 99520 - DNA, 666 bp, Homo sapiens
ggcaaaaacttgtaagaacagagagggttgactgttttaagctctgcgtaaaagtcttcatgtcgttccctgttaacatctggtggagaaaaagggagggaagaactgcatatttattgctgtgtttacaatgatacaacaaagacattcagttatagtgctctaagataaaaaaaaaaagcttgaactgcaatttataataatccttccttaatctatttatggttttaaaatagccagaagtctatgagagcagcctggccaacctggtgaaaccccatttttgctaaaaatacaaaaattagcaggctgtggtggtgcacacctgtaatcctagcaacttgggaggctgaggcaggagaatcgcttgaactcgggagtcagaggttgcagtgagccgagatctgtgccactgcgctccagcctgggtgacagagattctgtctccaaaaaaaaaaggtagtagtaacaaggattctggaaccatcaggttccttttaaaacatgtgactgttacccataagaaagttaaaactagcttaacaggtcgattgccaagataaatataaccataaataaacagagagcaatgtgtaattttgttcccaagtacttggtgttactcagaaaagagcctgtgagaggagcaagagagagttcaattgc

SEQ ID NO: 99521 - DNA, 319 bp, Homo sapiens
cttgctccctctgtactttgcctctgccaggagtccgcccagccctggcaggctggaagctcctaaagagcagggcctgggtttactcttcttttgttccttgatggccatatgctaaatgcctgctagctgatttcagctgacctgcctcttccacccaggatcttagcgagctgctcttggtcctggctggctgatgcaaagacacagcctcttccagcttcacttggcatacagcaaatgctatgcaagtgttagctatttattggtttagtgaacttgtgggctctaacacacagctgtgatatcactcctccgc

SEQ ID NO: 99522 - DNA, 505 bp, Homo sapiens
caatgcaaagctaacgtagaggttttctaacggtggataatgctctgaatagcatgtgacacaggcaaagaagtgaggatccttagctcattttcattttggacaagtcccaaaatgaaaatgttcacgactttcctggaagtcgtgggctttcaagaggccagccctactcctccttatccccacagtatagcacagactctcctcagaggtggcagcaggttctatggccagagagcagctaggagcaactgtcagtggggagggaaaggctctggataaagcagagttcaaagtgcactatcagagccagggtcctcaggcctctgcagtcttccctcctgcaaatgacagctgagaccaaagcatccgagcctggggtctgggctgaatttagcagtcataattacactgttaacgtctggggcacagccacagtctccgtagaaggcggcagcttttgttcatgcactaaaaacacatcatcttcaaacatgctaatcct

SEQ ID NO: 99523 - DNA, 726 bp, Homo sapiens
agattcctccgtaacaaccttagccacccctgcctgtgttagtccgtgactgtggagaacgcttggaaaagttgaaagaaaaagtgagaaactcaaataatggaggagtcattttatcggatgttgcctctctaccacaatcttactatgattatttaagtatcagagcctactttttcttttttctcttttcctcttttctttttttaatatattgcccagagtttaaatcagcagactgaatgggctgtaggggacctatatcaccataacagcactggaactcttcaaagttattcaaaagtaccaagactgtattcacaacttaatttagatgccttccacatcatttcttcaaatgcaactatgatgaaatttatgtgcacagttgggggatgtggataaaaatagtgttaattttctgattatctctagaactttctattatttaattgtaactttttgactatccttatgtttcatgatgactcggaaacaagagatctttttatccagttgtttcttccttttaacctggtttctctaccatcttggagtctcagtaattttctctatgttgtaattccgagttcttcataagcaatttctttgatattattttgtgtcatctctgagtggaagtctattttcttcctagaatatgagcaacttggatcctccttcttgaattcagttcagaaaataaatctactgtgttacatccta

SEQ ID NO: 99524 - DNA, 142 bp, Homo sapiens
cagaaatgaactcaaaatggatcaaagacctaaaggtgagagctaaaactataataaaactcttaggagaaaacataagggaagaacttcatgaaattggatttggcaatgatttcttggatacaacaccaagcataggcaa

SEQ ID NO: 99525 - DNA, 159 bp, Homo sapiens
cctgggagatggagactgcagtgagctgagatcacgccactgtactctagcctgggtaacagagcgagactccatgtaaaaataaaaaataaaataaaaagtcactttgagagcttttcataattgcgcctttttattttctttgaatgaacgcatatc

SEQ ID NO: 99526 - DNA, 326 bp, Homo sapiens
  misc_feature (13)..(13): n is a, c, g, or t
  misc_feature (18)..(18): n is a, c, g, or t
  misc_feature (21)..(21): n is a, c, g, or t
  misc_feature (43)..(43): n is a, c, g, or t
  misc_feature (71)..(71): n is a, c, g, or t
  misc_feature (73)..(73): n is a, c, g, or t
atggtttcttgancaatnttnacaggaacttggcatgttttanatatgggaaataacaaagtggccaaggnangcctcagtaaacacgcagggagagcacaccacacacctacacacgcatacactcatatacacataacaggcacatatgcacatgacatacacatgcacacatatacatatatcatgcacagagatagatacatacacacatgcatcctcatgcacacacactgcacacacatacatgtatagagacacacatcacacacccacacatgcatacactcatatacacatacaggcacatttacacatggcacaca

SEQ ID NO: 99527 - DNA, 245 bp, Homo sapiens
tgtgttttttttttttttgagacagattctcactgctgcccagggtggagtgcagtggtgtgatctcagctcactgcaacctttacctcccacctggaaggtagatgttagcgtagggtggtgaaaggcttgtgcactcatcttaatcttaaatatataccttggccaggcaaggaggctcacggctgtaatcccagcacttttggaggctgaggctggcagatcgcctaaggccaggagtttga

SEQ ID NO: 99528 - DNA, 672 bp, Homo sapiens
ggcggggacctcggagggagcccggcggcttcggccacctgtccccgcagatgctgcaggtgacatgagctctccagatgggcccagcttcccgtccgggccgctctcagggggcgcctctcccagcggcgacgagggcttcttcccctttgtgctggagcggcgggactcattcctgggagggggtccagggcctgaggagcccgaggacctagccttgcagctggagcagaaggagaaagacctgctgttggccgcggagctcggcaagatgcttctggagcgaaatgaagagctgcggcggcagctggagacgctgagcgcccagcacttggagcgtgaggaacggctccagcaggagaaccatgagctccggcgaggcctggcagcccgaggagccgagtgggaggcccgggccgtggagctggagggggacgtggaggccctgcgggcccagcttggggagcagcgctcagagcagcaggacagtgggcgagaacgggcacgggccctcagcgagctcagcgagcagaacctccggctcagccagcagctggctcaggcctcccagactgagcaggaacttcagagggaactggacgcccttcggggacagtgccaggctcaggcactggctggagcagagctgaggacgcggctggagagtctgca

SEQ ID NO: 99529 - DNA, 483 bp, Homo sapiens
  misc_feature (477)..(479): n is a, c, g, or t
  misc_feature (481)..(483): n is a, c, g, or t
gagaagagagggaagtctcatacctaacttttattcacaagtaatgatactgatattaaaattttaaaccaattttttatttcttaaggagtgtttagcattcattcttcttggggttatatagttatcagtaattggtttgtttgatttttgcatactttatataaatcctctaagattaggtttatatattgtaaattttggttgatcaacgtcatgtttgataattaaactgatttaaatatattttagtaaactagctttgctgttgatcttaaatatatagttaatatctcttccttctccttgaagaattccaccaaactttatatatttacatatttatataatgtgtaatacatggaagaaaaaaacaactttaagagcacatattttacttaccatctgttatctggaagtataattgattgtcaatgaatgtcatttcagacccataaatgtgttcatttctcaaannnannn

SEQ ID NO: 99530 - DNA, 378 bp, Homo sapiens
attctcccactggggtaacatctgagctacaccttgaaggatggtaaggcttgtctatgcagaaacagaacaagagaattccaggaaaacataaaggaagcacacatctacaagattattaatggggtgggcacaagaaacagcccagctgagccactgaaggggaagtagtgataaatcaggttggcaaagcagacctaaaccagcttgtgaaggagtctgcatgtctggccaaagcatttaagcctgtgattctcaagctggggtaagacacactttccccttagtggctttatcagcaccacctagtcttaaaaacgaattcatggatacatgtatatgtatgtctcacacattcacacacacatgcacaagtac

SEQ ID NO: 99531 - DNA, 698 bp, Homo sapiens
cttttaaaagtggtaggaaatatgcaaaaatgttgcttctgactatgggcattaatactgaccttttttctgtttctttattgtccaaatttgctatgaaaacacataattcaaaataactcaaagataaaaaagcatatataacataagatacagtaagagaatataatctgatatagccctctgaatctgttaattaagaggatacatatttacattcattctgtgcattgaaaaaaaaatacaagctttaaaatattttcaggaggaagctaaaaaacatcctgagtttaagacaccttacacaagagttgatactgtgatttcatcagtatattgttgtagaacaggcaaaactgatctgtacttaaaaagcattagagccttggttattcccggaaatgggacagggattgattaggaagaagcatgcatgtcctttttggggtgagtggtaatgttctttatcttgctcgttctaacagtttgagttacagaggtgtatatattgtcaaaactcagtgaatatactttaaaatttctgcatgtgtatgtaagttttacatcaaaagaaaatatactgttaaccaaaaaagaaatgtttggggaacatcttgtttcgtgaaaatgtacaaagtctctcgctggttttgtctccacatcccatggtcttagataagtgttccagactgagatag

SEQ ID NO: 99532 - DNA, 789 bp, Homo sapiens
atggtggcgcatcacatgcctgtaatcccagctacttgggaagctgaggtatgagaatcacttgaacccaggaggcggaggttgcagtgagccaagatcgtgccactgcactccagcctgggcgacacagcgagactctctttccaaataaaaataaaataaaaataaaataaggtggcagtaccagccaccttatgctgggcgaatcacttaaattcttggagtctttgtttccacatctaggaattggtgccagtagtccttgaccacctcacaggcttgctttcaaggtctcatcaaatgagataatttatgtgaaagcactttggtgtcatagaaatgtgaggtattatcttgaatgttaatgaatcgcttacagcttacaaacacaaatgaatcattccttttgacttaacaggcacctaagtaacttcaaaaatccagagcttcagccagacagctttggtgaagagtgatactgaggggacttggagatactgagaggacttagagaccagctgctagatccacccagagctggtcaggcccttggtgaagaacaactatcttcaagtgaaaccaggcttggaaaaaataacttaaaataaataaaaaaaaataggccgggtgcggtgactcatgcctgtaatcctagcacttttggaggccaaggtgggaggatcccttgagcccaggagtttgagatcagcctggacaatgtagggagaccctgcctctaaaaaaccataataaataaataaacaaataaataatgtggtaatatattga

SEQ ID NO: 99533 - DNA, 590 bp, Homo sapiens
agtggcaattggctggggtccacttccccactgtgagaggttttttcttttgctctctgcgatgaatcttactgctgcttactgtatgggtctgcacccgcctttatgagctgtgagactcaccactaaggtctgcagcttcactcctgaagccaaggagaccactaacccaccgggaggaacgaacaactctggacgggccgcctttatgagctgtaacactcaccgcgaaggtttgcagcttcactcttgaagtcagcgagaccaggaacccaccagaaggaagaaactctgcacacgtccgaacatcaaaaggaacaaactctggacacaccatctttaagaactgcaacactcaccacgagggtccgcggcttcattcttaaagtcagtgagactaagaacccaccaattcttggacataaaaccagtaattcttatcagcacaggcacaagctattttatttatctttgtattaatcatttattcaacaaataataactgaatgcttacaaagtattagcctggaattgtcaaaagaggatgataacatcccctttccccagaggagtgtttgaaaatgtatggg

SEQ ID NO: 99534 - DNA, 2145 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (8)..(8): n is a, c, g, or t
gncncnangaatgtttttcaaaaagggacattaaggcgattggagttatacttggaaaagaaagttctggccacagtacagagcatggcccgttgagctgttgggggggttattgctgcaaccaaggcttgagtgagggaagaggcggatgtagtgataaagagactccaggaactgaatcagcgtacctggcaccccatccattgtagagggtgagaataaaggagaaattaaagcatcttgcaggctgggcgcggtagctcatgtctgtaatcccagcactttgggaggccgaggtgggtgtatcagttgaggtcaggagttggagaccagtcagccagttagtagaaaccctgactctactaagaaaatacaaaaattagctgggcatggtggcatgcgcctgtagtctcagctacctgggaggctgaggaaggaggatcgcttgagcccaggaggtggaggctgcagtgagccaagattgtaccactgcactccagcctgggtgacagagcaagactcttatctcaaaaaaaataaaataaaataaaataaaataaaacatcttgcccctagctgagagagaggtctctgaagagcaggctcagggaaaagatgagttttcagagctgatgtgatagtcagcttctctggagtcaacagggtgaatccttcccaagtccagccatgcccagatgcccggagggaaaactgacccccagccagtagacattggctaagaacacagaatcttctgaccaaacacgctttcagcagctgcctgctctggactttgaaagaggtcaggtcttgccctaagctcaaaacaagtgagaggtgtcctgacctagctcatagggcaaatggtcctaataggatgggcaatccagatgcctgagccccttcactccgacagcaccagcgcctaatgcagccttttcattcttgccattaggaaatctgtggacttctagcctgtgttttaaaccagccatgtttccttgtatatttccctacccgctgccccacatacccagcatgccgctgtggccaccatgtcctcaaagccttctgtctgtatcaggaatgtagtctgagactgccaggaagcaacaaggagagagaaacactaactagtcttcctttataacccattcatactctctggctgtccccaaccttcatagtctcctgcatccaaatgtcctctttggctcaaaaagtaggccaggcatggtggttcatgcctgtaatagcactttgggagactgaggtgggaggatcacttggggccaggagtttgagaccagcttgggcaacacagcgcaatctcgtctctactaaaaaaaaaaaaaaaaaaattagctgggcatgatggcatgctcctggtggtcccagctacttgggaggctgaggcaggaggatcacttggtcccaggagtttgaggcgacagtgagctaggatcgcaccactgcactccagcctgagtgacagagcaagaccctgtctctaaaaaaaattaaaatgaaagaccaggtgctgggattaaggaaacacaggtctgagggtctgagggaaggggcctgcctcccagggagtcaacatagatgttccccatgaacagggatttgactttggaggccaacctggcctggcctctgccctttatctcacactccctatccttggcccactgccagtccctgccttgtggcaaaggggccccaaaagaaaagctgcccttccccaaatgtaaggacccaggtacactttcacccgtggaaagcagtgtctgtcgagagtctgtttcctattaatacttatcaaagccatgtgcgagggaggtggtcagctgtcaatatgccttagtatgtttatatgagtttgttttgttctaaaatacccaaacagttctggtcaagcggggctatgcccgtctggcccaaaacacagtccgttattaacgagatggccctggcaggcgggaacaaatctgcctccatgcactgcttcctgtagtcttttagaaagtaactccaggacatcgaagtgcccagatttgactcctaagttctaggagactgtagcgcagggtctgtcaaccttagcactattggcatttggggctgggtaattctttcttg

SEQ ID NO: 99535 - DNA, 1202 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (8)..(8): n is a, c, g, or t
gncncnangaatgtttttcaaaaagggacattaaggcgattggagttatacttggaaaagaaagttctggccacagtacagagcatggcccgttgagctgttgggggggttattgctgcaaccaaggcttgagtgagggaagaggcggatgtagtgataaagagactccaggaactgaatcagcgtacctggcaccccatccattgtagagggtgagaataaaggagaaattaaagcatcttgcaggctgggcgcggtagctcatgtctgtaatcccagcactttgggaggccgaggtgggtgtatcagttgaggtcaggagttggagaccagtcagccagttagtagaaaccctgactctactaagaaaatacaaaaattagctgggcatggtggcatgcgcctgtagtctcagctacctgggaggctgaggaaggaggatcgcttgagcccaggaggtggaggctgcagtgagccaagattgtaccactgcactccagcctgggtgacagagcaagactcttatctcaaaaaaaataaaataaaataaaataaaataaaacatcttgcccctagctgagagagaggtctctgaagagcaggctcagggaaaagatgagttttcagagctgatgtgatagtcagcttctctggagtcaacagggtgaatccttcccaagtccagccatgcccagatgcccggagggaaaactgacccccagccagtagacattggctaagaacacagaatcttctgaccaaacacgctttcagcagctgcctgctctggactttgaaagaggtcaggtcttgccctaagctcaaaacaagtgagaggtgtcctgacctagctcatagggcaaatggtcctaataggatgggcaatccagatgcctgagccccttcactccgacagcaccagcgcctaatgcagccttttcattcttgccattaggaaatctgtggacttctagcctgtgttttaaaccagccatgtttccttgtatatttccctacccgctgccccacatacccagcatgccgctgtggccaccatgtcctcaaagccttctgtctgtatcaggaatgtagtctgagactgccaggaagcaacaaggagagagaaacactaactagtcttcctttataacccattcatacaatggatggggtgccaggtacgctgattcagttcctggagg

SEQ ID NO: 99536 - DNA, 908 bp, Homo sapiens
agagagagagagagagagagagagagagagagagagagagagagatcacttggggccaggagtttgagaccagcttgggcaacacagcgcaatctcgtctctactaaaaaaaaaaaaaaaaaaattagctgggcatgatggcatgctcctggtggtcccagctacttgggaggctgaggcaggaggatcacttggtcccaggagtttgaggcgacagtgagctaggatcgcaccactgcactccagcctgagtgacagagcaagaccctgtctctaaaaaaaattaaaatgaaagaccaggtgctgggattaaggaaacacaggtctgagggtctgagggaaggggcctgcctcccagggagtcaacatagatgttccccatgaacagggatttgactttggaggccaacctggcctggcctctgccctttatctcacactccctatccttggcccactgccagtccctgccttgtggcaaaggggccccaaaagaaaagctgcccttccccaaatgtaaggacccaggtacactttcacccgtggaaagcagtgtctgtcgagagtctgtttcctattaatacttatcaaagccatgtgcgagggaggtggtcagctgtcaatatgccttagtatgtttatatgagtttgttttgttctaaaatacccaaacagttctggtcaagcggggctatgcccgtctggcccaaaacacagtccgttattaacgagatggccctggcaggcgggaacaaatctgcctccatgcactgcttcctgtagtcttttagaaagtaactccaggacatcgaagtgcccagatttgactcctaagttctaggagactgtagcgcagggtctgtcaaccttagcactattggcatttggggctgggtaattctttcttg

SEQ ID NO: 99537 - DNA, 446 bp, Homo sapiens
gcagtggctgggcgtctcacctgaccctggctgagctcctgctgatcttggagaaggaagggtggggccagactctggatggcttggagcccccgaccagggtccacactgggaagaaagcaaagggaagttaaccactcaaggttctcacgctgttttctcaagtaagaaagtaaactccctaaaccacaagaccagcacaaactaggaaggaccccacggcccaccaccatgcggcaccatacctaagtgttcctgaagttcacagaagggatgtggtagagaggggaaggacgttaccaggttttaaaacatattttaaagtttaaaatttttttgcgttagtaatagtgataataattgtacatgctgtgggttcacctattttaagtgtataagtcaatggtttgtaaaaaaaaatacataattatgcaactgctactaca

SEQ ID NO: 99538 - DNA, 153 bp, Homo sapiens
taagaggggtgagagcctcatcatgatggggagtcttattctgacatcttgggaaaaactgtccacgtgtgaagtcatcaacttgttttccttgtttacagtttgagcagctgttgttatggtgttgaacattttggtgagttctgagtggct

SEQ ID NO: 99539 - DNA, 347 bp, Homo sapiens
tgctgagattacaggcatgagccagagcacctggcctgagctactcttcatatgttcattggacatacgagtcctgccttctgcgaactgcttttgcatatccactgtccattttttattgtgttgttagtgatttggggctatttttttgtattctggatattaatcttctaatagttacatgcattgtcattatctttcagtagattgtctttaaattttgtgtatgatgtcttttgttgaacaaaagcatactgttttaatctagtcaaaatttgtctctcttttcctgtttaggcttgtggttttagggcctgtttaacaaagtcttctatgccccaagatca

SEQ ID NO: 99540 - DNA, 228 bp, Homo sapiens
actgtcaggtcatatgctgaaggcttgagaaattgcgtggtaagagatattgtaaatcgtatgattgggagatcaaagtctttcagttggggcaggaagcaggcctggttttatttttaaaggcacatcagtggtatccctccccagaggaggagaggatcttgtcttagaggctgcagccaagtgctgaaacagcttcctcctttgcctggaactgcagagctgtca

SEQ ID NO: 99541 - DNA, 231 bp, Homo sapiens
gtcttgaactcttgacctcaagtgatccacctgcctctgcctcccaacatgctgggattacaggcatgagccaccacatctggccagttattcataaaaaaatgaaatatacctcaaattaatgaacatataaatgagtataaatgtttatacatttattaatttgaggtatatttgaaaagcaaggatcaatggagagaaggtctcatttttgttgtcatctcttctgct

SEQ ID NO: 99542 - DNA, 111 bp, Homo sapiens
ttaagcgctctgggcctcaaaatctctctgcatcataatgattaaatgaaatcacagatataaagcacagtacctggcacccatcacatacatattcagtaaacagttatt

SEQ ID NO: 99543 - DNA, 268 bp, Homo sapiens
caaacacaatcatcttggtgcatactacctattaaatgaaggggagcaaaggcatcaggtcttcttcttgctaacctttgtgcttcctctatatgttcttacatttgaaaagtcttcctgacttctctggcatacactttctatgtgatgtcatgtggtataagacatgatctttcctacttgccatggcatgacatcatgtgatatgatgcgactttgtagccctcttcccctctccacgtcttgctattgtctagttggactaagc

SEQ ID NO: 99544 - DNA, 679 bp, Homo sapiens
ctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcgattacttcattggagggaaaatgaatcgttcctcaaatgtaccacgtaaaggtattctgaaatcaggtacaagatccttacaaaaagttcgcagagtacatttcgcaaatgcacgaaatgcaagatcattactatcgtaagtacct

SEQ ID NO: 99545 - DNA, 569 bp, Homo sapiens
gttaatactggaggtgctcagtgaatggtgtctataactggcgtcatgcctgttgggcctaaggagaaaattgtactgaatgatcgctggtgcccgagcctgccgaagcagaaacggcagtgagcctaccagggttgcacctttgctcttggcctaggcctttgccttaaggagtctgagctacagggaccgtgtgtgcagcagccctcttctcctggtgctctgctcacagggagacagtgctgcttctgcccacaacccactcactccccttagcatagagaagtggcagtgacaagtggggtactactcaacctccgcacttgcaaccccactagcctggcttccacaacctcttcccccacccctcatcactgcggcgatgccccaggaacctctctgactcccttctccctcacaccctgtgtgcagccatctgcctactcctaactcttttgtctttaatatgctcatccccactgcaccccagccgcgactgtccctgcccctggcctgggctgtggcacctgcttcctcactgatctctcctccaccaagccaactcctcc

SEQ ID NO: 99546 - DNA, 834 bp, Homo sapiens
agagaatgtgtggagatcaggtgatgcagaactctggtaaaggatgttagtcttcagagtaagactgttaaattcagcaaagtctactatcagaagacacgtttttctggttggtgtattactttattcagtgataatatgaaaattactatcttcactgaaggatctactgaataatcattttaactcaactatattgcattcttgaaagcaatcctttcaattgatctactgacttcacaatgtctgaaatcagattcaccaatctcacttgggatcaagttataacactggatcaagtgttagatgaagtaattccaattcatggaaaggggaatttccccacaatggaggtaaaaccaaaagacatcattcatgttgtgaacagatcaactcatagggcaaggaattattgttaaagatgccagattgaatggttccgtagcaagttacatacttgcaagccacaatggaatcagctataaggatctggacgttatttttcggtgttgagcttccaggtaacgaagaatttcaggttgttaaagatgcagttctagactgtctacttgactttttaccaaaagatgtaaagaaggaaaagctctccccagatatcatgaaagacgcttacgtacagaaattggtcaaggtttgcaatgggcatgattgtcggagtcttatctccctttcaaataacactgggaagaatttagaactaaaatttgtgagttcactcagacggcagtttgaatttagtgtagattcctttcaaattgttttggatcccatgttagacttctacagtgacaaaaatgccaagctaaccaaaga

SEQ ID NO: 99547 - DNA, 437 bp, Homo sapiens
ggtggttcctctctgtctaggtattgaggctctccaatacccccgagcctataccactgccccaggtctatttctggatcaactgcttgccttgctctggtaccaggtcaatgccaggttaggagtttacccaaattcgttagcctcctaatttgtttccgtactgaaaacaaagggaataagacagccatggtggtaaacacaaggcaaaatagaaaagcagatcagacaaagggtcccttttgtgaaatgacttctcaatatgggctttcccaaacctgtgtaggctcacacaatagaaggtaatttctaaaagggctctgttgcacacttaaggacaaggtcactaaaggactttgatttataaattattgccaaatataaagtcaatatataatcttctgcaggagaaccttgagaatccttgaaactgtcag

SEQ ID NO: 99548 - DNA, 607 bp, Homo sapiens
ttgggttaggcactgtggatatgaagatgaaaaaaatcaggtcccaaccacaggggctaaacaaacacataaatgggtctgaagggtttgtggcttagaggtgtgggtgtcagtccaggtactgctgcttttagttatatgaccttaggaatgttacctaccttctaatttactttctgaaagccactgtttccttcctttaaaatagggttatcttgttgtttagtaattaacttaaacttttgtgtgtatttgacaaagtctcaccctgtcacctgggctggagtgcagtggtgcaaccatagctcactgaagccttgacctcccaggctcaactcaagccatcctcccaagtagctggactacacatgcacacccacatccagctaattttttttttcttttttttttttctttttttttccggtagagacagggtctcgctatgttgccagggctagtctcagactcccgggcttaaacaattctgcctcagcctccccaagtgctggaattacagacatgagccactgcacctggcaagaaatcttaatagttgttttttgtttgttttggtttaatttaaaagactctctaattcttctat

SEQ ID NO: 99549 - DNA, 424 bp, Homo sapiens
tacaaggagttaatgtattttggagacagtgtatacacatagcaaataacacccttcttcaaattattagagaaaacagcacaatgggggatgatttctaacatccttttgcaaccagcagtactctcttggtttaagtggagagaaactgataatgaattccagaggccatgattttaataaaacaaaaacaaaacagaatttttttaaaaagcagattaatgccagaaagagattacaggctttggctatataacatgcttggtagaatatgtaaaatacttaaaatctttgcaaggtgttaagtccatgttccttttttttcaagattggcaagctttttatttattaagttggtatctgtcagtgtatcattcatatcccttcttcttcttgcctctgcaatgacgttggcacaaacctg

SEQ ID NO: 99550 - DNA, 669 bp, Homo sapiens
ctccgggtctttctccccgcgcggcccctctcccgagttcttctccttccggactccgggtctttcttcccgtgcggcccctctcccgagctcttctcgctccggactctgggtctttctccccacgcggcccctctcccgagttctccctccagactccgggtctttccccgcacggcccctcccccgagttcttctccatcccgactccagttctttctccccgcgcggcccctctcccgagttcttctccttccggactccaggtctttctccccgcgcggcccctctcccgagttcttctccttccggactccgggtctttctcccctcgcggcccctctcccgagctcttcttgctccggactccgggtctttctccccgcgcggcccctctcccgagctcttcttgctccggactccgggtctttctccccgcgcggcccctctcccgagttcttctccttccggactccgggtctttctccccgcgcggcccctctcccgagttgttctccttccggactccgggtctttctccccgcgcggcccctctcccgagttgttctcgctccggactccgggtctttctccccgcgcggcccctctcccgagttcttctccttccggactccgggtctttctccccacggcctctctcccgagttc

SEQ ID NO: 99551 - DNA, 633 bp, Homo sapiens
gaataatttttgacacagagtgagttatcttatttgttgactgaattaagtgactagcatcatttaacttaaagaaataaaccctgtatagtgactgggacatgagcatcaaaaaatacaatgtgtaatacggtagcttctttaagaagatggcacagtgtattagtccactaaggctgtcctaacaaaataccataggctgagtagctgaaacaacaaaaattaattttcttatagttcgggaggcaggaagtccaaaatcaaggtgctggaaaatcatagtgcttggtgtctggagaggcctttctttttggctggcagatgcaaccttctccctctgtcctcacatggcctttcttctgtggggtcaaagcggtgggatgcggaagctctggttagagctcctcttcttcttataaggacactaatcctgtcagattaggatcccactcttatgacctcatttaaccttaattatctctgtacaagccctatctccaaacacagtcacatttggggttagggcttcaacgtatacattttaagagggcacgagtataacatacagatttgtttgttttcttcctaggaaatgtgtaaaccagtgtgagtcaaatctatatatagcacttt

SEQ ID NO: 99552 - DNA, 515 bp, Homo sapiens
atgagttgcaactggacagaggaacacagggagccactggcctgtcctcaatgttgtactttttgatccatgtggagattatgtgaaggtttgtcttataattattaaaccatatatgcaatgctttcaaaattccgaaagtatattatttttgacctagagttccatacccatcaaaattacaattcaaatgttagtgtaaaataaagacagtttcaaacatgcaaagcctcagaaaatgtatcacgtatattttctcagaaaactatttgaggagaccctccataaaaactaatatgtaatcatagaaacaggaagaaacagaacctaacacagatatgaagtaaaggaaatcacaagcacaattagtaaatatctcaattcggaagccccagggtcacgactacgtcccaggtagagggcatgttgaaggccatcatcactggatgttctgttctactgtacaaccttttcaaccccagaaaagtactggaaaatgtgctccaaaaaaaaaa

SEQ ID NO: 99553 - DNA, 200 bp, Homo sapiens
cttttttaatgtcagtaatttgagactaatattttcctaaaagttcttacgtttgtcatttttttgcctggttattctgattttacagaaactaagcgtgtactccatttttaaaaagattttgaatactgtttagtggatataggaatttatttcataaagcctctagtttcttaaatgtattataattttatttattt

SEQ ID NO: 99554 - DNA, 368 bp, Homo sapiens
aataggagtggtgagggtgggcattcctgtcttgttctcattctaagggggaatgttttctgctttttcccattccgtatgatgggaagtatgaggttggctgtgggtttcttatagatggctcttattattttgagatatgttcctttgatgcctacttttttgagggtttttaacataaacagatgttaaattttattgagagccttttctgcatctattgagatgatcatcctgtctttgtttttagttctctttatgtgatgaatcacatttattgatttgtgtatgttgaagtaaacttgcaacccagggataaaacctacttgatcataatagattagctttgcaatgtggtgctggattca

SEQ ID NO: 99555 - DNA, 407 bp, Homo sapiens
aaacctgtgttgaatgaatcataaagtagagcttacagaaagttctgagcttccagacaaccaagtcaaaagaggaacaagctggatttgtacatctttcattagttagtaaaggggtgtgtataagttcctctgtaaatgcagacttatttttggaacttaattccaagaagaatttattgcatggacacttaaataagagaaaggagacatttggcaacagttttataaaagtacctacatgtcatttacagcctaagctataaaggtaatcaccaccagtgtagcctgtataaattaatacacaacagggagaggggaaaaaggaaatgggttaaggtatgaacatatgcactaccacccaaagagggaaatatgaatattggctacggtccttgttttcgcaa

SEQ ID NO: 99556 - DNA, 380 bp, Homo sapiens
aacccgggaggcagagcttgcagtgagccgagatcgcatcacttcactccagcctgggggacagagagaggctctgtctcaaaaataataataataataataatactattcatctcatgtttttctaccattatctacccattcctaatccagattaggcaattaatacaaataagcattgaagttagctctaatttgggaaaactgaattaattagcttctcctctttgtcacataccttcataaaaagtgacctttatacaagtctacatacaagaaaaaaggaaaaatagaaattttatactttagtgaaatgtacctaaagaaattttacctagtctttagttcagttctcaaaattctacatgaaattaagttat

SEQ ID NO: 99557 - DNA, 397 bp, Homo sapiens
tgtcagattggctcagtctgagtggaggatcaatgaataggtgatgaatgaatggatatctacatgtcagtgcattgacagtgaatacatcttgcttatcatagtgaaagaaacagccggacacagtggctcatgcctgtaatcccagcactttgggaggccgaggcgggcggatcacctgaggtcaggagttcgagaccagcctgataaacatgaagaaaccccctctctactaaaaatacaacattagccgggcatggtggcgcatgcgtgtaatcctagctgctcgggaggctgaggcaggagaatcgctagaacctaggaggtggagattgcagtgagccaaagtcgtgccattgcactccagcctgtgcaacaagagcaaaactccatctca

SEQ ID NO: 99558 - DNA, 404 bp, Homo sapiens
tgtcagattggctcagtctgagtggaggatcaatgaataggtgatgaatgaatggatatctacatgtcagtgcattgacagtgaatacatcttgcttatcatagtgaaagaaacagccggacacagtggctcatgcctgtaatcccagcactttgggaggccgaggcgggcggatcacctgaggtcaggagttcgagaccagcctgataaacatgaagaaaccccctctctactaaaaatacaacattagccgggcatggtggcgcatgcgtgtaatcctagctgctcgggaggctgaggcaggagaatcgctagaacctaggaggtggagatggagttttgctcttgttgcacaggctggagtgcaaccgcacgactttggctcactgcaatctccgtcgagc

SEQ ID NO: 99559 - DNA, 222 bp, Homo sapiens
agatggaagcagaggtggatggagaggctgctggaggcatcaagctgtggcctatttctgcgtactcgtctctggggacccagctgcacaccccctgattttccatcgcctgcaatcacagtggtacaaggggccacttcaggagactgaaggaaccacgtgaacccaggcaaagacagcaggtgcctctgaggctcacctgcttgcatgcagcaaggtctg

SEQ ID NO: 99560 - DNA, 331 bp, Homo sapiens
  misc_feature (309)..(310): n is a, c, g, or t
  misc_feature (314)..(316): n is a, c, g, or t
  misc_feature (319)..(321): n is a, c, g, or t
gaaagcaaaggcataagagaatatttgttgtgtcagcaatctaactctttatcaatacgttaagttgatcacattaaaacttctacctctcagccaggcacggtagctcatacctgtaatcccagcactttgggaggccaaggcgggtgaatcacttgagatcaggagttcaagaccagcctggccaaaatggtgaaaccccatctccactaaaaatacaaaaattagctgggcatggtggtgggtgcctgtaatcccagctaattgggaggctgaggcaggagaacggcgtgaacctggggtcgagcnnccgnnnatnnngtagtagtag

SEQ ID NO: 99561 - DNA, 340 bp, Homo sapiens
gaaagcaaaggcataagagaatatttgttgtgtcagcaatctaactctttatcaatacgttaagttgatcacattaaaacttctacctctcagccaggcacggtagctcatacctgtaatcccagcactttgggaggccaaggcgggtgaatcacttgagatcaggagttcaagaccagcctggccaaaatggtgaaaccccatctccactaaaaatacaaaaattagctgggcatggtggtgggtgcctgtaatcccagctaattgggaggctgagggacggaggtgacctgagtcctgaaggcggaggttgcagtgagccaagatggcaccactgcac

SEQ ID NO: 99562 - DNA, 413 bp, Homo sapiens
gcaaaaagatacacacagaccttagccagaatgcagagattattaccttcactgtaaacttgaacaagtcacataactctctacggctcaactgccagacaacagctgtcttgttcacttggcaggaacttttatgagattgaagtaaattctatgacttcttattgaatatgcactagaaaggcaaacaacagattctgggcattttccagaaattcttggggaagactatacttttaatttcagtattttaggctttaacattgtgaaagttgattttttgcactcaagtgcaactgaaggaagaagttccatcatgttaaatctttaaatgttcctttattttaaatcactatagggggaaatgtaatatacatgaagaatttagctttagaatgtttctttaaaacagt

SEQ ID NO: 99563 - DNA, 402 bp, Homo sapiens
agttcaaagaactagcatttgacgaaaatgtctttttcatgttagcttcctttttgtcttcctctctctgagtctcccttctactctgctagcactattcccacaagggacaagatggcctggggctccagcagccagttaggaccatgagggaatcttgagagtggaaatcacgtgccaaggatggcaaagcataaagagagaagaagccttggcctctggtaactgtggagcagtcacaccagcccacagccctggagactacttacagattgtgtgtgtgtgtgtgtgtgtgtgtgtgtgtgtgtgtcacagagagagagagagaaggatatggaggagaaacaggaggaagaggaggagaagggaaaaataaaccttccatcttgttaaaatcactgt

SEQ ID NO: 99564 - DNA, 471 bp, Homo sapiens
  misc_feature (2)..(3): n is a, c, g, or t
annacgggtgactgcgttggaacggggtgatgcggttgggtaagtgaatagatatgtagatgggtgagtgaacatgtcacaatggtggatggattagttggggaagggcaggaacatgtcacaatggtggatggattagttggggaagggcaggaacatatcacaaggtggatggattagttggggaagggcaggaacatatcacaaggtggatggattagttggggaagggcaggaacatatcacaaggtggactgttgcaaggtcggttaatcattaaggcaggaactagctgttccgtcttctttagtggttctcctgttgctccaggctttgtgactccaggaggcctgtaacgtgtgggtcacaggggtcacaatggctcgaccatggggtagcccattcaggggaccttccactggccaggttggtcttgaactcgtgacctcatgatccacccgcctcggcctc

SEQ ID NO: 99565 - DNA, 532 bp, Homo sapiens
ttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgccctgcaaagagcagggatgctgccctcccctactaaccctgcccctccatctgcatggtaaatgccttatgctaagaattcctggagtctgttcatgccgcgtggctggtatgatgtcatatttccaaagccgacagctccctctactggcctggtctggagaactgcagtttgagtgccttgagtcagtcaatcttagacaacccaattctgtaacattttccaatttttagagcagtttgtgtttattgcctgttttttttagatggagttttgctcttgttgcccaggctggagtgcaatgatgt

SEQ ID NO: 99566 - DNA, 662 bp, Homo sapiens
ttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgcccggggacggggacagaacgggagggattctcaggggcagctgtgggtttgggctgcgggggagccctggttcctgagctgaatcggggagagtcccagttcagaggagaatttatgacttggtcagaacccaggaacaatgcctcttcatgttatttatcttattttattagcagtgcacacgatcacgatcttagtgtgatctcattgtgatgttcatgttgttttgaagtgcttccttttttctcagtttataccgtttcaaataagagagtagaacttggtgagtctcggtttcccagcgttgccttatcttttcctgtgagcttttctgagctcttctgattggccatggcagcgccacacccctgcccgctggccagccaggagggctcctcagccagcttggggcttgcctggctcctccttcagacccct

SEQ ID NO: 99567 - DNA, 697 bp, Homo sapiens
aaataaactgggtactctctacctcacccctagtggtaggctatgaaacaaatcgattcagtttaaaatagtttatgtgccgactagtgttaaaacgttcatgtatgcattaagatcacaccaaatcacctgactgattccttcatcaaaagctcctcttggcagttagcagtacacacctaacattagccaaacaggttatctaccatcaacacggagaaataagaaactttgtattgccatttaaagaagttgctttctaaaactagacatgaataagggagagaagaggaagtattaaacccctaaactaattaacgaaataagggaggggggatgcaggaaaacaatgataattagtatgtacccttggttaaccaaatccacacatacattcattctgtatatgcacaaacatcagcagcatcataaaccgtctcaagttctagccattattcagttcgacatctgcacatgtttatgcgtctctccaaacaacctcttgaacaccctgctggagctgtcatttttttcttctccctatctggcagatggcaagtcaacaatcggcatcaacagcagccgaatatctccccctccatcctacccccctaaacagacacaataataacttctttgtgcttccctacaatgcagctgcttaaaccatttcgctacaaggctgctttgccttaat

SEQ ID NO: 99568 - DNA, 5044 bp, Homo sapiens
aacgtcccatttgcccgagactgaaggatttctcaggctgtggacatttaatgccaaaaccaggaatatccggggcaaagcaggctgtgttgttcgcctttgtggagccaggcagtgtgtggcccagggaaagctgcgtttcatggaggcttccaggaggctgccctgtaaagccaggcaggtggcttcaagtgccattcctgcaagtgcccctgcttcagctctcaggcccatccaatgcctcgagcccacgggggtgtcccggcaggtctgcgtcatcacgacccagtaacgctgctggctgtgtcctcatgccctcttcctctggctggccagtcatctttgtcacttctacacctttgagtgtgtacaggctgaatgttgagtgatgcccccccaccctctcaataaacacacacacacacacacacacacacacacacacacacacacaatgttattaggcacagcagctccatcctgctccctgagaatggcagtgcaggcacagagaagagcagttgggaagacaggcagctggtctaccctgtccccgcacacttcacaggcactccactgcttggcaggaattctgcatggcatctgccacgcatgctcacagggtgaaaaatcaagctgtcactctgcaaaatctaaaaaccctggaaaggtctataagatgacattagacccagttaagaagcaagtgtcacctgagttggccatgcaatgaatgaatattataagcagtattggagaactaggcggttgcttactaagaagtgtcttggaaacattcgagttcatacagtgcatgacaaagtaatagaaggctgcaagcgctgaaaatgcacccgaatctggtacctaggatgagtacatgaatagtgatgaatagccctttgtgctgtgtgctatatacaaccatttgcattcagaaagcagcatttgaagctgagttccattactggtgattgaagtattttcaggagcagatacatgtggtgcatgttatatgcacttagtttgaaagtatccctcacccaaaaagtgcagaacctctgaaaggtgagccgtggtgcaggtgcccccctcgctgttcgggtcagttcttggccatgcttggcctgtcacacgccgggtctcaacaacatcgtgcgaggagacagtgactggtttcagcccaagagtcaactgttgagcatgacatcaggaagcctgtactgtcctgatcccaccaggcttgggttaatttcctattgcttcagagaaagagaggcgctcttgtgcttttgagagagctctcatgttaaaaagaggttgtctttgcactgcgcttggtatgatttgttttcttataaaacaggaagagaacctagaatgtgcctttcgtgaaggtctgacaaatggggtctcagagtcctaggacccgcaccaaggtcagagtccacctgtagaggctgagcatttctacatgcacccagggtgctgggctgaggctaagggtggacgcgtagaccccatcacaggcttccttcctgagcccaagtcccccatttggtcactatcccttctcagagcaagtggattctcttttcctcacttggaatattcaatgttgaagtagtggcctggagtggcctttccctcagctgcctgtctgggctccctggcttcccggatcttcatctcatacgtgaggcaataggaggagtttctattcattgagacaaacagtgagcgggcaccaacaggccagcagcttggcccttttcacagaggtggccttggagtctggagtctgggcagctgtctgcctctctacggctctgcttcccagcgggcacacgggtccggagcctcagaatgaagtggtgcagaggcgcagggcacacctaggagaagctcaatgaccaccaaagcccttgaggagagacggggtttgctgtgttagagaaatggcaacccccaggaccatgcacggctctggcagtgcacagtggctgattttcaccagttcctcctacccctgcctctgtcggagactagaaaacattctaccccttcaggtcttcttttaaaagaaaagagctatggcaaagcgtgccatacaaagttaaaaaaaggaagagtggctttgcgttcttgaccatggccacaattctggtcacttctagcatctgaccttgagaacggtgtagaggctctgagccaccgctggcctttgagagagtctcactctccagctagctctttgtgtagtgtccagggccccggcagtcaggatagagcgagcaaaagaagatggacagtggacagggcgcagtggctcacgcctgtaatcccagcgctttgggagagcgaggcgggcagatcacaaggtcaagagatcaagaccattctggccaacatggtgaaaccctgtttctactaaaaatacaaaaattagctgggcatggtggtgcgtgcctgtaatcccagctactcgggaggctgaggcaggagaatcgcttgaacccgggaggcagaggttgcagtgagccgagatcgtgccactgcactccagcctgggtgacagagcaagactccgtctcaaaaaagatggccatgctggccaaggctgggctcataggaaatatctgtagtaggatgaaaggaatctggcctagggagccccggactcggtttacctaccccgtactcatcccactcatctgtctaccctagtgtccatcatgccctggatgaatcataggtgggagggacagaagccgagaacaccaggcacacggggtggggggaatggggggagcccaggtgatcccctttggaaagtggattgatcctctcccctgtggaatgacagcttaacctgattaacccactggggcttgctattttatgagcatttttaaacagaaaggaaagatgatatcccagtgcaggtagactttatttttgaaagcatcgtggcccctcgcctctccctctcccccagaaccttggccagaattgagtcttcgcgttggggaggccacgctggaaccattgctctagggctgaaggtggaagtagggccactgccgcagcttcagccagagccctcgctgcttcgcagaatttaacaagcacacgactgggattcctttggatatgagaaaggaaggcaagtgcgggcaaagggaagctcctcccgtttttcataaacagaagtaagatgtcctctttcccaggtttgcacaatcacttctggcaaattaattgaaggtccttgaattcagccagtgcacgaaacctttgcatgttcttctgaaactgtacttcttccctattctgtctacccacactctgcgaactttgccttttccttaaacacattccagaccaaacactgttcagtttgttaaaaaaaaaaaaaaaaaaaagatgtatatacctgtatgtgatccaccacccttttgaggggcacctggtcctcggttggggctgcaggtgtgcctgacatttgcaaaagatattccagtctttcgatgttcagaattgaaaatgtggagatagaaaagctcaaacagactcctaaaaggagggtttctttcctgaagactccaagaaaatgagtgtgcagatgagttagcttgacaacctcaactctggggagcaggcaggcggtctgaggaagataagggcccacgccccactcacctggcacctgttcggtggtcccggggcatcacggtctgcagctctgggcccccagccccactgtgaagtcagtcctgcatgctggccgaggcccggccacctcccgatgcctccagagtcagtgggaaggagtcagcccttcccagacttccccgccacctccagcaggagcagctcagtttgtggctctggggagctccgcttttgcaaacccaaaaaggctgtgcatttggaagccaaacgctcagcatgcggctgccgagtctggttttgtggacaaagcaaactgtggaatggcttctcggtgtctgtataaagggacaaacggttgcattcaccctttgtactataacaccgcttctgcattcgccatatccgttttttaacctttttgtctccggggaacttctcattcgattattatgtcttctgatgatttgccatgttattttaaaggtgattttattttcttatggacaggaaaaaagaaaatgaggaggagttggttttactcttagagataagacttcagcaggggctcagaaaccccaaactctagttaaattgcttctcggaggaaaatcttaatctagacagattcagattcccaggctctcctggaagccctgcacttcagggcacaggggccctgggacgtggttggcagccaggctgcgagagagctaaaaaggaacaagaacatcagctcggatgtttgtctctcagccctgacacctgccactctccttcccggggcacttggccctatcagagggacatgaaatgctgtccaaatggtggcagaaatgcagcgacattgcatgcagcagagtctttgcttcgaaagatggggcgccatgtttcagagaacatttatcttagtcccacgttcaggtgagaagacctcaaaggtaccctctgtccagaataaacattggaacaatctctcaattggcttttgtcactacacataatgtaatctcccttctttcagctcccccaacagtgagcatgcttcccaaaaaattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcactgcaaaattgttcatgggtctatgtagcaaatgattctctgccttgacaatcatgtatacatatcaagatttctatcataatgataatgagattgatgacttcttgttttcctccaataaagacaattaatcaccttcaaaaaaaaattt

SEQ ID NO: 99569 - DNA, 5034 bp, Homo sapiens
  misc_feature (4959)..(4959): n is a, c, g, or t
  misc_feature (4969)..(4969): n is a, c, g, or t
  misc_feature (4980)..(4981): n is a, c, g, or t
  misc_feature (4985)..(4985): n is a, c, g, or t
aacgtcccatttgcccgagactgaaggatttctcaggctgtggacatttaatgccaaaaccaggaatatccggggcaaagcaggctgtgttgttcgcctttgtggagccaggcagtgtgtggcccagggaaagctgcgtttcatggaggcttccaggaggctgccctgtaaagccaggcaggtggcttcaagtgccattcctgcaagtgcccctgcttcagctctcaggcccatccaatgcctcgagcccacgggggtgtcccggcaggtctgcgtcatcacgacccagtaacgctgctggctgtgtcctcatgccctcttcctctggctggccagtcatctttgtcacttctacacctttgagtgtgtacaggctgaatgttgagtgatgcccccccaccctctcaataaacacacacacacacacacacacacacacacacacacacacacaatgttattaggcacagcagctccatcctgctccctgagaatggcagtgcaggcacagagaagagcagttgggaagacaggcagctggtctaccctgtccccgcacacttcacaggcactccactgcttggcaggaattctgcatggcatctgccacgcatgctcacagggtgaaaaatcaagctgtcactctgcaaaatctaaaaaccctggaaaggtctataagatgacattagacccagttaagaagcaagtgtcacctgagttggccatgcaatgaatgaatattataagcagtattggagaactaggcggttgcttactaagaagtgtcttggaaacattcgagttcatacagtgcatgacaaagtaatagaaggctgcaagcgctgaaaatgcacccgaatctggtacctaggatgagtacatgaatagtgatgaatagccctttgtgctgtgtgctatatacaaccatttgcattcagaaagcagcatttgaagctgagttccattactggtgattgaagtattttcaggagcagatacatgtggtgcatgttatatgcacttagtttgaaagtatccctcacccaaaaagtgcagaacctctgaaaggtgagccgtggtgcaggtgcccccctcgctgttcgggtcagttcttggccatgcttggcctgtcacacgccgggtctcaacaacatcgtgcgaggagacagtgactggtttcagcccaagagtcaactgttgagcatgacatcaggaagcctgtactgtcctgatcccaccaggcttgggttaatttcctattgcttcagagaaagagaggcgctcttgtgcttttgagagagctctcatgttaaaaagaggttgtctttgcactgcgcttggtatgatttgttttcttataaaacaggaagagaacctagaatgtgcctttcgtgaaggtctgacaaatggggtctcagagtcctaggacccgcaccaaggtcagagtccacctgtagaggctgagcatttctacatgcacccagggtgctgggctgaggctaagggtggacgcgtagaccccatcacaggcttccttcctgagcccaagtcccccatttggtcactatcccttctcagagcaagtggattctcttttcctcacttggaatattcaatgttgaagtagtggcctggagtggcctttccctcagctgcctgtctgggctccctggcttcccggatcttcatctcatacgtgaggcaataggaggagtttctattcattgagacaaacagtgagcgggcaccaacaggccagcagcttggcccttttcacagaggtggccttggagtctggagtctgggcagctgtctgcctctctacggctctgcttcccagcgggcacacgggtccggagcctcagaatgaagtggtgcagaggcgcagggcacacctaggagaagctcaatgaccaccaaagcccttgaggagagacggggtttgctgtgttagagaaatggcaacccccaggaccatgcacggctctggcagtgcacagtggctgattttcaccagttcctcctacccctgcctctgtcggagactagaaaacattctaccccttcaggtcttcttttaaaagaaaagagctatggcaaagcgtgccatacaaagttaaaaaaaggaagagtggctttgcgttcttgaccatggccacaattctggtcacttctagcatctgaccttgagaacggtgtagaggctctgagccaccgctggcctttgagagagtctcactctccagctagctctttgtgtagtgtccagggccccggcagtcaggatagagcgagcaaaagaagatggacagtggacagggcgcagtggctcacgcctgtaatcccagcgctttgggagagcgaggcgggcagatcacaaggtcaagagatcaagaccattctggccaacatggtgaaaccctgtttctactaaaaatacaaaaattagctgggcatggtggtgcgtgcctgtaatcccagctactcgggaggctgaggcaggagaatcgcttgaacccgggaggcagaggttgcagtgagccgagatcgtgccactgcactccagcctgggtgacagagcaagactccgtctcaaaaaagatggccatgctggccaaggctgggctcataggaaatatctgtagtaggatgaaaggaatctggcctagggagccccggactcggtttacctaccccgtactcatcccactcatctgtctaccctagtgtccatcatgccctggatgaatcataggtgggagggacagaagccgagaacaccaggcacacggggtggggggaatggggggagcccaggtgatcccctttggaaagtggattgatcctctcccctgtggaatgacagcttaacctgattaacccactggggcttgctattttatgagcatttttaaacagaaaggaaagatgatatcccagtgcaggtagactttatttttgaaagcatcgtggcccctcgcctctccctctcccccagaaccttggccagaattgagtcttcgcgttggggaggccacgctggaaccattgctctagggctgaaggtggaagtagggccactgccgcagcttcagccagagccctcgctgcttcgcagaatttaacaagcacacgactgggattcctttggatatgagaaaggaaggcaagtgcgggcaaagggaagctcctcccgtttttcataaacagaagtaagatgtcctctttcccaggtttgcacaatcacttctggcaaattaattgaaggtccttgaattcagccagtgcacgaaacctttgcatgttcttctgaaactgtacttcttccctattctgtctacccacactctgcgaactttgccttttccttaaacacattccagaccaaacactgttcagtttgttaaaaaaaaaaaaaaaaaaaagatgtatatacctgtatgtgatccaccacccttttgaggggcacctggtcctcggttggggctgcaggtgtgcctgacatttgcaaaagatattccagtctttcgatgttcagaattgaaaatgtggagatagaaaagctcaaacagactcctaaaaggagggtttctttcctgaagactccaagaaaatgagtgtgcagatgagttagcttgacaacctcaactctggggagcaggcaggcggtctgaggaagataagggcccacgccccactcacctggcacctgttcggtggtcccggggcatcacggtctgcagctctgggcccccagccccactgtgaagtcagtcctgcatgctggccgaggcccggccacctcccgatgcctccagagtcagtgggaaggagtcagcccttcccagacttccccgccacctccagcaggagcagctcagtttgtggctctggggagctccgcttttgcaaacccaaaaaggctgtgcatttggaagccaaacgctcagcatgcggctgccgagtctggttttgtggacaaagcaaactgtggaatggcttctcggtgtctgtataaagggacaaacggttgcattcaccctttgtactataacaccgcttctgcattcgccatatccgttttttaacctttttgtctccggggaacttctcattcgattattatgtcttctgatgatttgccatgttattttaaaggtgattttattttcttatggacaggaaaaaagaaaatgaggaggagttggttttactcttagagataagacttcagcaggggctcagaaaccccaaactctagttaaattgcttctcggaggaaaatcttaatctagacagattcagattcccaggctctcctggaagccctgcacttcagggcacaggggccctgggacgtggttggcagccaggctgcgagagagctaaaaaggaacaagaacatcagctcggatgtttgtctctcagccctgacacctgccactctccttcccggggcacttggccctatcagagggacatgaaatgctgtccaaatggtggcagaaatgcagcgacattgcatgcagcagagtctttgcttcgaaagatggggcgccatgtttcagagaacatttatcttagtcccacgttcaggtgagaagacctcaaaggtaccctctgtccagaataaacattggaacaatctctcaattggcttttgtcactacacataatgtaatctcccttctttcagctcccccaacagtgagcatgcttcccaaaaaattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcactgcaaaattgttcatgggtctatgtagcaaatgattctctgccttgacaatcatgtataccagtnaagtatttgncagcatccgtnngtcnctaacttgtttctatttttacagccacacaattcttggcatgtattaag

SEQ ID NO: 99570 - DNA, 1795 bp, Homo sapiens
ccgcctactactactactgctcgaattcaagcttctaacgatgtacggggacatgttcttctgaaactgtacttcttccctattctgtctacccacactctgcgaactttgccttttccttaaacacattccagaccaaacactgttcagtttgttaaaaaaaaaaaaaaaaaaaagatgtatatacctgtatgtgatccaccacccttttgaggggcacctggtcctcggttggggctgcaggtgtgcctgacatttgcaaaagatattccagtctttcgatgttcagaattgaaaatgtggagatagaaaagctcaaacagactcctaaaaggagggtttctttcctgaagactccaagaaaatgagtgtgcagatgagttagcttgacaacctcaactctggggagcaggcaggcggtctgaggaagataagggcccacgccccactcacctggcacctgttcggtggtcccggggcatcacggtctgcagctctgggcccccagccccactgtgaagtcagtcctgcatgctggccgaggcccggccacctcccgatgcctccagagtcagtgggaaggagtcagcccttcccagacttccccgccacctccagcaggagcagctcagtttgtggctctggggagctccgcttttgcaaacccaaaaaggctgtgcatttggaagccaaacgctcagcatgcggctgccgagtctggttttgtggacaaagcaaactgtggaatggcttctcggtgtctgtataaagggacaaacggttgcattcaccctttgtactataacaccgcttctgcattcgccatatccgttttttaacctttttgtctccggggaacttctcattcgattattatgtcttctgatgatttgccatgttattttaaaggtgattttattttcttatggacaggaaaaaagaaaatgaggaggagttggttttactcttagagataagacttcagcaggggctcagaaaccccaaactctagttaaattgcttctcggaggaaaatcttaatctagacagattcagattcccaggctctcctggaagccctgcacttcagggcacaggggccctgggacgtggttggcagccaggctgcgagagagctaaaaaggaacaagaacatcagctcggatgtttgtctctcagccctgacacctgccactctccttcccggggcacttggccctatcagagggacatgaaatgctgtccaaatggtggcagaaatgcagcgacattgcatgcagcagagtctttgcttcgaaagatggggcgccatgtttcagagaacatttatcttagtcccacgttcaggtgagaagacctcaaaggtaccctctgtccagaataaacattggaacaatctctcaattggcttttgtcactacacataatgtaatctcccttctttcagctcccccaacagtgagcatgcttcccaaaaaattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcactgcaaaattgttcatgggtctatgtagcaaatgattctctgccttgacaatcatgtatacatatcaagatttctatcataatgataatgagattgatgacttcttgttttcctccaataaagacaattaatcaccttcaaaaaaaaattt

SEQ ID NO: 99571 - DNA, 414 bp, Homo sapiens
ccaagaggaaagtctgaggtataagagggagttgtaagccaaaaaaaaaaaaaaaaagagaaaaaagtaagtatgaaggaaatctaaacaaacattgattatgcaaaataatgtctaattcggagagtaaacaaatagagtagatctaaaatattgaatgaaaataccatttaagatgggaagctggttatcagtattccagtgttttaagggtacagctattgattaccttgaggctttacatatacatggtgaaagagtaagggacagccacttaattggtacaaatagagtgcatacttcaaacactgtagaggagataatggcatttcaaagttattggtcaatgccaggtcgggtgcagtggctcatgcctgtaatcccagcactttgggaggccaaggtgggcggatc

SEQ ID NO: 99572 - DNA, 2370 bp, Homo sapiens
gaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctaggcttcagaaaccggaacaacagcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtctccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagtttggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaacc

SEQ ID NO: 99573 - DNA, 483 bp, Homo sapiens
ctggaaaaacctgaggaaggtgccgggcccagcgtggtgaatcctggtgggggcggagcctggcccggaaggctggtggggcggggctaagaggggaggcgtggccaaggctctgagcacgtgggccggggcctggctcgaggaacaccaggtggagttgctggagccaagggacagaaatgagtggagatttgagatgcgggcttagagcctaatgggcgaggccaactcaagtaggaatcgaaggggcggggctactggagaacggaatcacccagaacgaaaaaggggtccggtagaagggattcagaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaacc

SEQ ID NO: 99574 - DNA, 2278 bp, Homo sapiens
gaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctaggcttcagaaaccggaacaacagcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtctccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagtttggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagggccctggcagacatgctggaaacgccggaaccctgacccagtcgctcgactgcgacgcaggtgtacctccccctgccttccaacccctttccacgagctatatttatttctccgaataaacgtgctccccgaaacc

SEQ ID NO: 99575 - DNA, 873 bp, Homo sapiens
aggaaacccaaatgatgacattcgatatgatcttttccttagctgtgacaaggaccctcagaccaccgtcattgagaatggccgaagccagcggggccggttttcttttgaagtgttccgatttgtgaaacacaagaatcagaaaatgtccactgtcttcttgcactgcgttaccaagctctgcagagcagatgactgccccttccttatgccgatttgcagccacagagaaaggagagatgctgggaggaggacgacttggagcccccagagctcttctggcagcgcggtgctctctgctggtcccatcattactcggagtgatgagactccaaccaacaattcgcaacttggttctccaagtatgcctcccttccagctgaacgccatcaccagcgcactgatatcaggaatggtcattctgggagttacgagcttttctcttcttctgtgctcactggcccttctgcacaggaagggacccacaagtttagtgttgaatggcataagaaacccagtctttgactgactataacagattcctgctctctggagaaggcttcactgactaaactatgtgtgactgcagtcagtgttccgtctgaatttcatgtcagtccacattcaatatttgtaggtttgataaatttcacagtatagcttgtcagcataatgatagtgaaagaagtttattatattgctattgtcacttatgtacgtggcgagccgtatttttatgccaccagtgaatatattgacaataagtgaaaaatattcaggacttagggcttacaggatcagtaatatttcattttatttcagttttcttttgattgttggttaaaagataaaaggtgggagtagacaaaaaat

SEQ ID NO: 99576 - DNA, 316 bp, Homo sapiens
agtgttggaagtggggcctaatgggaagtgtttgggtcatgaaagcaggtctctcatgaatagattaatgccctccttttggggtgagtgagttctcactgtatttgttcctgcaagagctggttgttaaagagagcctggcacctctctcttgtatcttgctttctctcttaccatgtgatatctccacactctagctctcttttaccttccactatgagtagaagcaccatgaggccctcacaagatgcaaatgttcaaccttgaatgttgcagccgtcagaattgtgagccaaataaacctttttttccttac

SEQ ID NO: 99577 - DNA, 632 bp, Homo sapiens
tgtatttaaaatgagggtctataaatttattatgattagtatgctatagaaagttcttatgagggatccgtcatagtagtggagctagtgggtatgcaatgttggcactggtggtcgtgggaaaggtcgtagtatgggagacagcatttggcctcatagggttgaggaccactcctctgggggaagtgtgttccaggctaaaggtacagcaatcacatgaatgccttgaactgtccaatgcagggaaggtattgaggctggagcagagtgacaagggaaaagtgagaggtcacagaaattgccaaggttcacatcatatagggcctggaaggtcatggtaaggaccttgcatcatgctttccactctagctagaataaaatgcaatgtggctttgagcaagagagtgacagggtctcatttaggctcctgtgggattgcagactgcagaggggtgcaacggaagcagggataccaattggaagtccactgcagaagtccaggcactgaggacgggtgtggtggcttactcctgcaatcccagaacttttggaggctgaggcaggtggatcacctgaggtggggagtttgagaccagcctgaccaatatggtgaaaccccgtctctactaaaa

SEQ ID NO: 99578 - DNA, 438 bp, Homo sapiens
ccctgtcaaaatagaaagtggcatgactattcctcctatgaaagcatcctgtatggaggatcagaccaaatgctaaaacactttagtaggtttacctaaatacagcttgtctttcatatatcatgccttgacacttcttctgcaagaccagttttttctgtaagactaattgatattgagatttcaatatatatagaaatgggactaaattttatccaaagctatttttgcctctattttgggggcattcaagttaatttcccccacttacactaaactgtcaaatactagaatgtggaagcttgaatattagagataagtaagtgcccagttccattccaccagttcacagccctgtctatccctccatcccaccctcaccaccaccctcctaaagcaagattattaacactgaactggactgctaaaacttcttcc

SEQ ID NO: 99579 - DNA, 383 bp, Homo sapiens
ccaggatggtcttgatctcctgaccttgtgatcctcctgcctcggcctcccaaagtgctgggattacaggcgtgagccaccgcgcctggcaatttttgtatttttataatagagacagggtttcaccatgttggccaggctggtctcgaactcctgacctcaggtgatctgcctacttcagcctcccaaagattacaggcagagacggcacgcctggcccttggaattctgtcattagcttctgtaattgtcctctttcatagtccaatgtaagctccaggatggctggggtttgttttgtgtacctctgtatccccagccactaagtgcagtgcctggcactgtggatgaagtcaacagtggttgaaagaatcaaaggcagc

SEQ ID NO: 99580 - DNA, 300 bp, Homo sapiens
gcatggtttgtgtggaactggggcccaggcaggtgtgagtgcaggtcttctgtgtgccagccggagcacatagcttgtcgcctctccaacagacatggaggccatgaagacatctgctcctgccagcatccgccgctgccccctggtctaaaagtgggctgacctggggacggcccctcatcagacagatgcgtgctgccggcctcctgccgctccccttgctggtcagacccacagggcccgtgcacatccggggccccagtgggctgtcagaagccatgcaggccccatccgtatggt

SEQ ID NO: 99581 - DNA, 214 bp, Homo sapiens
ggtagtagggacaggagggcacaaaaagaatacatcattaagatgtgatctgtgttctagaggaactcacagtctagtacataaacaatgtctcagctcccaaaataagtatgttgctgtattttatccaagcagaagaatcctgcttgttatggtaagaatcttatgtctaaagcaatatcatcctgattcttgataatcaactcttaataat

SEQ ID NO: 99582 - DNA, 234 bp, Homo sapiens
gaaccagggacaggatggaagaccaaatacatatttcttctcatttcacaatatcgtaggatgttggggcaggatgattctggagggagttcttacctaagactagaacaatgtgtgagtgttagctagtgagagaacactgtacaaaaggcctgggtgggaaagcggatggctcattcaaggaactgaagaagaccctcaatattggcatagcttaaagagcttagagagtta

SEQ ID NO: 99583 - DNA, 304 bp, Homo sapiens
acctggtgaagacacggtcagaagatcatctttgaaccagaaagctggacctcaccagacactgaatctggcggtgccttcatcttgaactttccagcctccaaataggtgaaaaataaatttctgttgtttataagctattctgtttaaattatttgattattgcagcccaaatagatgaagccaaaaagttatattagcccctttcgtttggagaaaaaattatattatcgttgttgtatttgttattctatatttattacatacatgtaatatccagataataaacatgttcaaaatgtat

SEQ ID NO: 99584 - DNA, 411 bp, Homo sapiens
caggttagagagaactgtgctagaattctagctgtattacttaatagttatatacccctggacaaactaagggctctgagcctcagcttcctcacctgtataaagggagaaataatacctgtgaaaagggctaaaatgaggttaaaatgcagggagcctggcgtgttgctagtgcctagtacatgccagtgtctggtggcagctcttgctgccgtgactgctctcatgatgccatgctgcctgggctattcctggagtgaaatactgaaaaggagcacagagagaagagtctggaatagaaaaagaaatgttgtttttttttcctaccatacccttgtccgcctcctggtctcaggtgttctaagaaaggaaacgagttgttttaaagcatctcagtcagtgctgcctccc

SEQ ID NO: 99585 - DNA, 759 bp, Homo sapiens
tgctgcagtcgcctggaggcccgtttgtacagtggaaaagtagaaaatgagactctaaaaatctcatcagccaaatacaaaacattctccttgctgctacgtggcggcctccacagagccctaaaaccttgaagctcggagacctatcttgaagggggagcaaaggcgggatgcgggaagtttgagtccatggaagacactgataccctctccattcctgggaaccctgagcctgaaggacccggcctgaacagcggaaggactgaatccctgtgcaactcatcggtgatggaacataaagccatggtgccctcggtccccaagacgggagggatggggaaggccctgggtgaaggggacaggcggggaaggaaaaggtgaagagaaaggtgctccccagggagggggtagatgtgcccaggacatgggacattggcagaattttaactccgagcacacacacaggcccacggacggcttcccgtctacctgttccttacgggtgtgctgtgccggcctgggcacctgcctctttccccatgccaggtcacttgccgtctaccctgtatactgccactagttctaagcctcccagaacaccctgatcagggccctgtggcctctgttacaggattccaggcctagacgtctgctcgattggaaaactgcccccagagatgccgtggctcagagctcgtcctgctttggggtggcccctggagtctccgcccctcagcaacccacatggtgacaggcacc

SEQ ID NO: 99586 - DNA, 298 bp, Homo sapiens
tgtccaggcagcacatctgatgtccattgtgaggatgtgctgcagcctccctctgtatgtaagttctatgaataaatgctttggactggtcgccctggagtttagtgcttctttctttggaatcctaactggtcccatctaggaaaggtctggggaatttcactgtgggaattgccctgctgccacttttagggtgactccagctgctggctgcaggaggaaacatgttctcataaacatatgtggagttggtgctggctgagttccatacgcatgggtctttcatcctcaaggaagc

SEQ ID NO: 99587 - DNA, 530 bp, Homo sapiens
cagcctgaccaacaggaagaaaccttgtctctactaaaaatacaaaaattagctgggcgtggtggcgcatgcctgtaatcccagctactcaggaggctgaggcaggagaatcacttgaacccgggaggcggaagttgcagtgagccgagatcaagccattgcacttcagcctgggcaataagagctaaactctgtctcaaaaacaataacagaagcaaagactaacatgttgccatgcctgtctgcgttcttccaggctaacgctgcttttaacagatggaattttcttcttaaagaatgaatcccccaggggattgttgccagctccctgctgaaccacagcaaggcctctgtggggccctgggcctggcatcccagatgctgtttggttttctctttatagcacagggatcatcctggcatctcagattttcctagctttcccttcccaactatctgctgctatcccatccctggggaagtagatggtttagctttggaggccctggtggattccaagttatagctgg

SEQ ID NO: 99588 - DNA, 163 bp, Homo sapiens
actcatttgatattcacaacaaatctgaaagttaggcagtaatggctacattttagctaaggaagcgaaggcgcagacagagactagcttgcccaaagcaaacagccaatcagtggaggagctggcagcgcaacccagatgtccaggattatctcattcagtg

SEQ ID NO: 99589 - DNA, 259 bp, Homo sapiens
taatcatggaggtattttacgcttggtaaaatgaagtgtcggaacaatcaagtgtgtattttggacaaaaactttccttctcctgagaaaacagggtgtttgctttgcttggtcccagtactaaaagatgcctgtcttcattaatctaattcatcagataattgctcaactctttgttttccagctgtaaagggagaaggatgaaagaaataacctaaccatgacagttaatattttgtgatagcagaggtcgacgcgg

SEQ ID NO: 99590 - DNA, 1004 bp, Homo sapiens
cattttatggaaattagcttagcaatttttttttctcttttaagaatcaaaatatggatttgatactaggaacagaatctgctctttatttcattccttttttgtctcttctgcttcctctgcccctcccccagccacgcagcacgggtgccagtgtgcatgcgtgtgctgggggccaaatgacagaaccccggttgaaagtccgcttgtaaaagcacaagtgagaggcagcatcaggcccctggagggctgtggtcctcggactcggttctttcctgtcccctggccgtcctgtcatccctgtgtgctgcagcatcaccacggcctacttcccaatatccacaaagcttcgcctttgcttttgcactctcttttacatttttttacttctttcctttttcttaagttcggatccaagtttgtcttcttatccatcaccatgctccctgaaagcctttttgagattaagaaattttcttaccaggaggcaactttccgtctgtcctaaagggaagtgggtgctggatttattagatattgggttcctggattaagatgacttcctcacatagcttggagtctgcagtttctcagttagaagtgttctatatttctttttgttccattttagtgcgctgtgctttgtataagtggtctttctatgggcagtttcaccttccatgaaggcttataactcaaccactactacccattcagaagagcagaaagcatctgctgtgtgagcgttcatatgttacctaatgtgtattttgctgtcgtctcagctgatagatgtcagtgagtctttctgactaggtttattggtgttgataagaaattaaaaaaaggattcataacgtggtgattgtgtctatcatgtatattttaaatttctgaacgtactttcatttagctgtttttctttgctttctaaagatgtataacaatcatgtatatgtattatattgaagaataaacatggaccttatttatcttttgattaa

SEQ ID NO: 99591 - DNA, 918 bp, Homo sapiens
gtagtcctcaggcggagcccaggttggggatgtcatggcacatgcagcttccacttctgtcccactgtttccctgaggctctctggctcacacattccaaagagagttgaagaacctctggatacagtttaaagagcaagatttcaatctgacatcctcaatctacacttaaggggcaaaccataaacccttgagaaaggacgggaacacacccggagaggcataggaggaaaatggcccaaagaaacaccttggctaaaaaatgtcgctgcctctgaagtccttaaagtgattcactgtctcttcacgtgctgaatctgagagtgctgtaggcgatgaaatatcacctgccatcttacacatgcatcagaaatggacagaaggaggaaagaaaagaaggtgttcacataaaacaagacttcagttgctgtggaggcaggtgagcctcacatagcttctaatttcatgcatcagagtacagaaatcaggttcttttgttcaccttttagaatggatgtcatactaatcacacagctggggacatctttccaattgtgtgacgtctgctccagaatgatggtctacttcaactcggacaaggcaggagagtgacccgccacccggggctccaaacagagccctgccctttcagccacaacatgcagcagcaccaggacctctgggtttgggccctggacacactcagcacctttgtctcagctctcagaccttctctggaccctcctgtcctcgtgtctcacgcagagcctagcacagatgaggcacccactcaatcctgacccaagaagtacatggatacccacgttcacaccacataaacaagggaaaaagttattcaataaacactgatcggccgaaaccctcccctctctcccaccggctcctcgcaccataaac

SEQ ID NO: 99592 - DNA, 1031 bp, Homo sapiens
  misc_feature (22)..(22): n is a, c, g, or t
  misc_feature (25)..(25): n is a, c, g, or t
  misc_feature (28)..(28): n is a, c, g, or t
  misc_feature (31)..(31): n is a, c, g, or t
  misc_feature (37)..(37): n is a, c, g, or t
gactagatgtaacgactctctnatntcnacngctcangttcttttgttcaccttttagaatggatgtcatactaatcacacagctggggacatctttccaattgtgtgacgtctgctccagaatgatggtctacttcaactcggacaaggcaggagagtgacccgccacccggggctccaaacagagccctgccctttcaggtcttcgtacctcccttcacagtatccttctccctcaaacagcctcccagatgagtgtcaagatactaattattctttaagatcaagatcagatgccacctctttcataaagacttcctttattcccaaatgtcagctctgctgcctggcctgcctgcctgtgttcctctcacacagggctccttccaatcaacctcagatggagggcggtcatccaggcatctgtctctcccaagagacctaagatccttgagggcaggaaccacatggagtttatttttgtgtcccaatcctagcacaaagttcgccgtgttaaatatgaatgccatgcttttctcatcgcgaaccatgaggtgacttgggaacagagccatgcacaaaacgagacagaggaagtctaggtctctgacagtgtggtgtgcccaccagccatgccacctctggactctgcagatgagaggaataaacttctctttaagccactattattttgagggtctctgtgacatgcagcctaactcacacactttcctgctacctgtgctctctgccccaattccacagccacaacatgcagcagcaccaggacctctgggtttgggccctggacacactcagcacctttgtctcagctctcagaccttctctggaccctcctgtcctcgtgtctcacgcagagcctagcacagatgaggcacccactcaatcctgacccaagaagtacatggatacccacgttcacaccacataaacaagggaaaaagttattcaataaacactgatcggccgaaaccctcccctctctcccaccggctcctcgcaccataaac

SEQ ID NO: 99593 - DNA, 303 bp, Homo sapiens
ctatatgcatgttacctgctgcctgcagtgctttactgcctctgtactgtgaagaaatctaagctttgatactgggaaagattgcaaccttctgcaccccttaccccacccaaaacgggagcagaagaatgaaaatatttcaagagaagggacttactggaaaattgttaagttacctgaagtcatgattcattcaaataagagcctttctgataaagtagaacccaatagccctaaccagtcaaatccattttcttctcaaacatttcccaggttctgttttgtataagacagtgtgaatac

SEQ ID NO: 99594 - DNA, 756 bp, Homo sapiens
aactgtcaaccgcctgagttggaggagcctatttataaggagcgttgtcatgtgtcttcgggggagccaggaccgtccgaggggttggctggcccttcacaatgtgaccccgctcccatgggctccctctttcctcctgcacagccctggggtgcaggagtccctctggaaggcaacagcttccagcgactcaaaggcctgcaaggtcatgtgaacccagcatcacaggtctacccacagaaccagcaattttatcagtagtattatttatcctctgcaaaaagagacactgaaaacaaagttccctttctcaaggaactctgatgagaactttaaaaatatatttgaccttggaggattcattgttttggaagccatggagacctgcctcatgcaacccgaaaaaaggattgcatctgtgatgtgtgggacaggcacgaggggcctctacaaccaatttaccctgtgtcttgacttctctgagagttgcattgggttcaacagtgatcccatttcctcccaaagggccactgggagatcaggcagtatcaaacttatatccaaaaagctctatacagtttcaaggtgtttccaaagcacatcctctgatcctcataccctccagggtggtaggcaccacaaggcatttgcatttgctctgagatgaagatacgaccatagggttgtacccagaaggtctcatgactctggacatccagctctttccaccacactccaacattctcaaagggagaa

SEQ ID NO: 99595 - DNA, 434 bp, Homo sapiens
gaccaactggggacaatgtgtgactcaaaagtgactgtaggaaagtcaaggacatgccaatgtaatgcctacttgcactatacggatatatggagctgtggggacagagcctcagaggctgtccagagccttgggcttggcaactggttctgccacttcctcaatgcatgaggctgcgcgagcacctgcatcttcacctgtagaatggggatgacattggccccacctcacagtgtctgtgtcagggtcactgagtgagcacatgacaagcacttacgatggtgcttggcagagagtacaggctcaaagcagcttagctgctatgactggtattacgtaactcttggagcctctgtttccctcctgtggaacagctgaggtgctggctttaaaacctgtccacaaagtctttgatgctgctcccattcagtggt

SEQ ID NO: 99596 - DNA, 288 bp, Homo sapiens
tccctacatggcacccgacccatctgtgaccccatcatatacagatgcacgtggaatttcctgtaaatgtcgattataatgcaacttgatcaaacaagccactggaaggaaaacactgtgtcttacctccctacatacctaaagccacctcaccagagataaaacatagcattccaatacctcacgcacatgggtaaaactagtcttgtgttcctgtcacctctaatggctggactctgctcacccttcggagcccagatcaaacactccctccttaaagaagtcttc

SEQ ID NO: 99597 - DNA, 411 bp, Homo sapiens
ctccagtcccagccccacaaggcctgtcctgggtggacacgccgagtgtgagaggttccagttagttcctctgcccagtcccagccaggacaggctctgcctctggccagtttgaaagagcaggctcggctgggtgcggtggctcacgcctgtaatcccagcactttgggaggctgaggcgggtggatcacgaggtcaggagttcgagaccatcctggctaacacggtgaaaccccgtctctactaaaaatacaaaaaaaattagccgggcgcggtggtgggcgcctgtagtcccagctactcgggaggctgaggcaggagaatggcgtgaacctgggaggcggagcttgcagtgagccgagatagcgccattgcactctagcctgggtgacagagcgagactacgcctca

SEQ ID NO: 99598 - DNA, 554 bp, Homo sapiens
atgtttctctgccacggctccaggtggtccttccgttcggggtccctgacttcccacaacaaactcccaagaaatcctatgcactcaagataccttttagggtttccaatggtgtatggtttcaaaactgctgttccctctgtacttacttcctgttgaattaaagtgtctttgagaggcaagagagtatgatgtttgttcctagcctaccagcctatcaggctggcatgatagatacactctatgaggctgacatgcccttacttgattcttttgtccagtgaaaatatctataaccagcatccaagagggatactgttggtgaaacctgcttagccgaggactggctgtgtgtgtgcctccagaccaatcatatgtttgttttgagatacattttttggaggaaggtaatacacacatgccatgtattttctttttgtttcatactttttcttctttaatttcctggtatccattggttctctccaggcaattggtggcatgttagccacagtggacactgcacaggagagcaaggggtgggggattagggt

SEQ ID NO: 99599 - DNA, 286 bp, Homo sapiens
ggtaggctaacaaggggactaatacacttacccaggactcagtctttttctgaggtgaaaaaaattgagtatgtgtatgaattcctactaaacatttctctaagagtcaagaatgttcatcctgtctccattcgaatgacttttttttttttaatgatcttggaggcataaagtcaagctccttggagttttggcatatagttttccagtatttattggaaaatatgggcatgtggggaattttgagtatttctcttaataaaatgcccccagaatgaaaatgtca

SEQ ID NO: 99600 - DNA, 305 bp, Homo sapiens
tctagatctcacttcaacaaacagtgaagaaggagtgtggtagaggagagaagaaaacaaaaggatgacagagctaagaaggacagaaatgaaaagagcattcgttcagtctgttctctcattatcgtacctcggaaccttggaagattcttttttgagaattcttttcattatgatgctaggaaaatgatagactggaaaagccagaaattctgaaattctataaaacatgatctcatcaataatgtataccttccctacaacttgcagaaaataacatattaaaatgtccaattttaaagagg

SEQ ID NO: 99601 - DNA, 515 bp, Homo sapiens
caggtgaggaagctgaggctccaagacactaggcaacttacctaagcgtcacagctcagaaacagaagcagatttggaggccagatctgggaggccacaaggctgggtccttggcacagcctctacctcctctccaggtcatctcctgcaacccctccctgacccagccactgtccagtcaccacggtgcccatggtcacctggcacacctggctgtgtcctacattaatgcatatcctcacgcttctgcttctcctgcctggaacgcacctacctatcacctaatgaacttctactcagcccagaaagctctgctctcaagttatctccttcaggagacagaccttcaccccggggcccccttccataagagaaaaacgatcccctttggctgggcatggtggctcacgcctgtaatcctaacactttgggaggccaaggcgggtggatcacttgaggtcaggagtttgagaccagcctggccaacgtggtgaaaccccgtctctactaaaaat

SEQ ID NO: 99602 - DNA, 1192 bp, Homo sapiens
atgtgactaaacataggtcatttttgataaatgaatactaacaatttcacaacataattgacaagctgattacatcagtaatttataagaaaattatacaatcaagttcatagattcaaccaaagaagtagaaataagggaaattaagacaaaactatactacatcagtatcactgccttaagtaattcacagcacaacctaatgtgggcccatgaagagtaattcaaagaagtgtgggccttacttgaaacttcagagatgttgatcatgaatttggcttcttttgatgagaaatggccaagactgttgacccatgcacacatgttggtatttacagttgtttcatggacactggccagtctacaagcagagcactctcatggggagcaccagatgagttccagccgcagttcttttataagctttaagtgcctcatgaagacgcgaggatctcttccaagtgcaacctggtcacatcagggcacattcagcagcagaagtctgtttccagtatagtccttggtatggctaaattccactgtccctttctcagcagtcaataatccatgataaattctgtacaacactgtagtcaataacagcagcaccagacagcatattaattcttttaccataaatttgtgtgtaattataatgttctatgtgtggtgttatcaaaagaatcactgtgtctctaaatatcatatatgtatgtctggataaatacattgctgtacaacatctccaacatgcaggtcatgctctaggacttggggatatagagtaatacatgtttcgtggccaataataaaagtgacaattgtcttcctaacaaaaaataaacatgagaaataggaattaatcagcagtctcaaggctcccaaatgccttagtgatattatttatccctctatttatattacggtctttttcttccctcacatgctcaatacatgagacacgctattgctgttgaattcataggaatgcataaatagactttcttccactcagactgaatatgactccctaaggattttgttggagtgtagtaatgaatgctggttgctaggtagtagaaactgacactgcagcaggcaaccaagtgcaatggtgaaattgctgcttaaaccctgcttatcaaaaagattcacagtgccgattaacttaggtagtctacagagcatcatt

SEQ ID NO: 99603 - DNA, 1015 bp, Homo sapiens
caatgtccagaaaaagagcaggcctaacggcatctttttagcaagtttcctggcagtaaagtgaaaaaggatgaatgacagcaacttagtttacttgcagcttcctgtaaatttagtcatctgaacaagaggggactgaactgtttcaaaacagaaagcaattgtttcatggacactggccagtctacaagcagagcactctcatggggagcaccagatgagttccagccgcagttcttttataagctttaagtgcctcatgaagacgcgaggatctcttccaagtgcaacctggtcacatcagggcacattcagcagcagaagtctgtttccagtatagtccttggtatggctaaattccactgtccctttctcagcagtcaataatccatgataaattctgtacaacactgtagtcaataacagcagcaccagacagcatattaattcttttaccataaatttgtgtgtaattataatgttctatgtgtggtgttatcaaaagaatcactgtgtctctaaatatcatatatgtatgtctggataaatacattgctgtacaacatctccaacatgcaggtcatgctctaggacttggggatatagagtaatacatgtttcgtggccaataataaaagtgacaattgtcttcctaacaaaaaataaacatgagaaataggaattaatcagcagtctcaaggctcccaaatgccttagtgatattatttatccctctatttatattacggtctttttcttccctcacatgctcaatacatgagacacgctattgctgttgaattcataggaatgcataaatagactttcttccactcagactgaatatgactccctaaggattttgttggagtgtagtaatgaatgctggttgctaggtagtagaaactgacactgcagcaggcaaccaagtgcaatggtgaaattgctgcttaaaccctgcttatcaaaaagattcacagtgccgattaacttaggtagtctacagagcatcatt

SEQ ID NO: 99604 - DNA, 1085 bp, Homo sapiens
ttgtgctagatgcttcctgccctcaaacattggagtccaacttcttcagttttggaactcagactggctctccttactcctcagcctgcagatggcctattgtgggaccttgtgattgttgtcttgctctgccatgctggagtacaatggcaatcatggcttaactcagcctcaacttcctggacacaactgatcctcctgcctcaacctcccaagtagctggaactacagttgtttcatggacactggccagtctacaagcagagcactctcatggggagcaccagatgagttccagccgcagttcttttataagctttaagtgcctcatgaagacgcgaggatctcttccaagtgcaacctggtcacatcagggcacattcagcagcagaagtctgtttccagtatagtccttggtatggctaaattccactgtccctttctcagcagtcaataatccatgataaattctgtacaacactgtagtcaataacagcagcaccagacagcatattaattcttttaccataaatttgtgtgtaattataatgttctatgtgtggtgttatcaaaagaatcactgtgtctctaaatatcatatatgtatgtctggataaatacattgctgtacaacatctccaacatgcaggtcatgctctaggacttggggatatagagtaatacatgtttcgtggccaataataaaagtgacaattgtcttcctaacaaaaaataaacatgagaaataggaattaatcagcagtctcaaggctcccaaatgccttagtgatattatttatccctctatttatattacggtctttttcttccctcacatgctcaatacatgagacacgctattgctgttgaattcataggaatgcataaatagactttcttccactcagactgaatatgactccctaaggattttgttggagtgtagtaatgaatgctggttgctaggtagtagaaactgacactgcagcaggcaaccaagtgcaatggtgaaattgctgcttaaaccctgcttatcaaaaagattcacagtgccgattaacttaggtagtctacagagcatcatt

SEQ ID NO: 99605 - DNA, 908 bp, Homo sapiens
gccactgcacccggccatggttttatattaaaaataataaaaatacggtgaatttctggttgaaatggggaaaggcctgtgatctccgttttcccagtgcttagcgctgactcagagaccctgagtgggacacacgactgcatggagtacagttgggaaacaactgggctagtctgggcctcctgagtctcagaggggagcagggggaagagctctgggcaagtcactgggctgaaccctggccagcccagtgtatgaccctgggtatttcaggtcatggggtgtgagtcctacctcgtgcctcttatcctcctaggtgtggatgtggaggcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggcccccatccaggacgaggatgagggggaagaaggtcccaccggtgaggggcct

SEQ ID NO: 99606 - DNA, 896 bp, Homo sapiens
gcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaggcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggaccttcggaaccaaaaagaagcttcccagagccggggccaggagccccaagcgccctctagcagcaaacacagaaggagctctgtgtgtcgtctgagcagtcgcgagaagatttccctccaggacttgtccaaggagcgccggcctggtggggctggggggcccccatccaggacgaggatgagggggaagaaggtcccaccggtgaggggcct

SEQ ID NO: 99607 - DNA, 380 bp, Homo sapiens
ttggccattggttattagctttaccttcagcccctctttcctccctggatgttgggggctggggctcaaaatttcaattctttaatcacaggctggttcccctggcaaccagcccccatcctggataatatccaggatgcccccatatccaggaacccacagccatgctagtaatctcactaggacacaaaaatacacttataactttagagatttcaagggttttaaaagctatgcaccaagaaatgactgcaaagaccgtaaatatatttattattgtgtcatatcaggttactttaagcttgtccattctgttttttcatcttctcaaaatatgtgccagaacattgtttgtttatatgccattaatattgatactt

SEQ ID NO: 99608 - DNA, 752 bp, Homo sapiens
tgcgactatgcctgcgggagggcgagggcgtcctttggaggcggttccctctcacgccgccgccctctggctcctgggcctgccgggtctcggcgatgggcgagggctgtgcccggtgcctgcggctccctccgcgccgtggacccccgcggcctcccggccttccttaccccggcggcctggcggccccgcgagcttcacctccccagcatccgaatcgcgcagctcctcccgcgagcgcccgccgccttcgctccccaggccccagctgagaccgccaggaaggcgggctcctcgaccccagatcataagaggtgtctgggaactaagggtgggagggggccagggtagaaaatgtcagttcaagtacgttaaaattaagaacttaggctttgtttaaaaaacaataaatgaagtgaaaaaaacaagccacagagtaaaagaagatacttgcagcaagtgataaaggattagtatccaggatatataaagactgttattgagtcaatgtgaaagagaaaaacacctgaagcaaagaatggatgccggcattaaataggcacttcaaagaggaaccatgaacgaccaaaatcaagtgagtaggtgaccagttcccattagtaattaggaaatagcaaattaagaccacaaagagggcagtgagggtggctcacacacctctaatctcagcgcttgggagtccagggccagaggatcccttgaggccaggaggtggagtctagcctgggaaa

SEQ ID NO: 99609 - DNA, 450 bp, Homo sapiens
gtgggggtaagcaaggcaagcatttctccataccattgtctgtgatctataaatagcacaagtgattagggtggggttaatctttagcctacaggcctggccagtggccccgatcagtctgttatttttcagttcttacttcctccttttctttggagacaggagacagtaagagaaatggcctctctcctcacatttagtgggagaatagcatctctaaaccatcaaattaatatctatctcctaaacagctttcaaaaagcacatgactttgccagttgcagtgtctgatgtctgtaatcctggctctttgggaggcctaggcgagaagatcacttgggcgcaggagttggaaaccagcctgggtaacgtcagaggcgttcaaaccagagtgaccccatcttgaataaagcctgggtaaaatgaacctgacacctattggactccatt

SEQ ID NO: 99610 - DNA, 619 bp, Homo sapiens
cgtgacagaagcacgactagagctctacaaagaaagatgcatttagctgagtgtcaaaaaatgaagaggagcctatggggatagaattgtggttgaaggaggtcatagttggtttaggaaacaggtcaagtgaaaagagggctggacagaacgcttgaaaagaataccttttaagggacgatggaaggagagcaagtgaagataactaaatggaagcagaggccaaagaataccaggagtgaatggtgtatcagaaatcttaaaagggaagttttgagatggagaagtgggaagaggcatcaactgctacagaaaagctacatgctttctaagatctctttctgctaaaacaaatttctttgattccttaagaatataaaaatccacaaagaaacaaactaccctttccattaaaggcaaatattttctatctctttacattttttttgaagctaaatcctaaagaaaaagttccagagcactagttcagaaacttgagctcagtttttatattaacttactgtatgcatgacatttattctcagtaagtgggagtttgcaaggattgttaactcctctaagagagggattctatggataatacaactggacagctagg

SEQ ID NO: 99611 - DNA, 121 bp, Homo sapiens
gacctggctgtgctgttggctgttcttgcacactcaaggtggttttgccattggcttcctccctcagcctgcctctgggattatgccactgctattcttttttatctaccatcagcacaat

SEQ ID NO: 99612 - DNA, 96 bp, Homo sapiens
ggctgtacacactaacacctgtacacatgtgcatgtattcatgggttagcctaatagaaaagagtatttactcactatgcttgctagtagatattg

SEQ ID NO: 99613 - DNA, 379 bp, Homo sapiens
taaagaggctatggagcccttagctcagagaacaactatcaacatatctacagaaaaatgcacataaattgaacaatctctctacccttcttacaaacattcttccataacaaacttctgaaatagaacaagggaaatgcagaagagtagtcttttatttataaaatggtgctacaattaaaatacttacttggaagaatttctaacctgctcagtcattgtaaacttctatgagtccactttcaaactctgaggatccgcaatcaccacaatatctaacaggtaactctaaggtttagtccctcccttatttttatttgaagttttcctccttaacctttttctgaagtgaaaaaaggaattcaagtcagatagaacc

SEQ ID NO: 99614 - DNA, 342 bp, Homo sapiens
gtgccatatagctctctctaacctgggattcctgggctcaagcagtcctcttgccttagtctcctaagtggctaggaaggactacgggcctgtcccaccacacctggctaattttttcatttttgtgtgtgggcgtgggggcagtcttgcccaggctggtctggaactcctggcctcaagtgatcctcctccgtcaagatatgttaatataatttaagcctacttcataacaactttttctagaaatatatctactggtgcatgtttcaaagagagattttagtatttggatagttgttcaccacaagtctaaaactcacaggttaaatttattgtttactg

SEQ ID NO: 99615 - DNA, 769 bp, Homo sapiens
tcctatgtctgtctgtgtgtctcttacaaggacacttgttattggatttagggcccacctggatgatcccagatggcctgggtgggtcttaaatatctcctcatcttgaagtccttgagatacctcctcatcttgaagtccttgagttatctcctcatcttgaggtccttgagatatctcctcatctcgaggtcctcaagctatctcttcatcttgaggtccttgagatacctcctcatcttaaggtccttgagttatttcctcatctcgaggtccttgagataactcctcattttgaggtccttgagatacttcctcatcttgaggtccttgagctagctcctcatctcgaggtccttgagctatctcatctcaaggtccttgagctagctccttatcctggggtccttgagctacctcctcgtctcaaggtccttgagatatctcctcattttgaggtccttgagctatgtcctcatctcaaggtccctgagacatcgccccatctcaagatccttaccttacatcttacaaagtcgttttctccaaaaaatgttcacaggtcaccttcacagcttccagggatttgacctggatacatctttagagggggccagacccattccagacagtaaacaaatagacaaaacgctggcacattgtaataaatgtcacagatgaaacaaacccagggatcaaggggaagaagaagaggagggcatgctttctggagggtggtcaaggaaagctgagagctgcaggaggagga

SEQ ID NO: 99616 - DNA, 468 bp, Homo sapiens
cagcttataccgtccggtcggtattacacgcttgatccatctctgtcctattatacaatgccagtcttctaaaatgagaatgtaatttttaatatttggaaaatgatgtctggagcatactcactgatgtctggagcatattactgatggaagtgtaaactaatacaacttttctagaaagcaatttggcacacttaccaaaacctttcaaaaactcacagccttttctctagtaaatcccttttgatgtgcatatttctttctcccactatcatcaccatcaaaagaatccaacaaatttgaaatcatcaaggatttataactggccttaagatagtagcctggacttttccctgcacctcattatatactcaaggtagcattctattctcacatggagctttacaatacatgcttttaaataaagatgctctggccgggcgcagtggctcacacctgtaatcccag

SEQ ID NO: 99617 - DNA, 775 bp, Homo sapiens
aataaatgaaataaatagtaaagaagtaatactgttgctggtgaatagaatgcattgtcgcatattatatgtggatcttctgtttatcatcttgctaaactctctcctttatatattcagtcttctaggagaggattcatacaatcacaaaataattacagttttatttcctccctttcaggcctttgacttgaatttgttttccttgtattggccgaaatatatggaatagacatggtgatcttggtcttcttcctgattttaaaggatactaattattttaatggaatttatatgggcctcatgaaatgagttgggaagtaatctttttttctctactctctaggaaaatctataaaattagaatgacatttttcaaaaaagttgacttgcctgtgaaactaactgggcttggtgttttctttgtaggaaaggagcccatttctgacattcatcatactgtttagcaagccactaattttacaaatgaaaccgatttatgacattcattttgctgctaaaaccccactcctattgatcaacgtatgtacagtgaagcctttgtggtagctgactctgctgtgcagccttaaggtgaaatgttagctgaccactcttgaagagcaagttcctgattaaagacattgacttccctgaagtgtatcttaaatgaacatacacacacacacatatgcaggcatgcctacatacatcacattatccttgccaaagtatcttaaagaaagttacagtattttaaagtaaattgatctcc

SEQ ID NO: 99618 - DNA, 354 bp, Homo sapiens
tgatatacacctataccatgagctatactactatacacgatataccacaatctagtaattgcttatatagtataattgcagtggtagaatcctagcttttctacttgctgattgtattaccatgcccaatttaacctctccatgtctcacttttttcccatatgtacagtgagaataattataatctttatcctgaggagttgttatgaggattgaatgaggtaattcatgtttccttgggaatgccccacagagttaattgatattattatcattgttctgttttttactattttagaggtgctttggaatcatagaaggaatgtatggctttattaggaagggttgtattag

SEQ ID NO: 99619 - DNA, 653 bp, Homo sapiens
ggctgtgtttgccatacacagagtcattcatattaagtatcttcctaaaggatatcctctaccggccctgtgaggctgggttttatagccccgcttatcagaagggaacgctgggctcttctggacaagaacagtaggcccaggatatatttggagatagactggaccagatgtaggtgggtgagggcaactgggaagaatcaaggatgacttttgcgtctcctccagagggagcagcagggagatggaggagctgatgtaggctgactgcctcttggtgatcccaggtgatcttatttgtatatatgtatatataaaccatggagtagatgacgtggtacagactggatgcagtattaggtgtggagattatgtatgcagcgattaggtgtggaggctctggagcctgaccaccagggtcaaatgtagccatgtgattttggaccacttctctaatctccccatgcctccgtttccccacctcaaacttggagatggcaatcctaagtttgccagccttctctaacactcactacgtgctaggagccattctacacacttagtgacaccatctcatacaatcattaaacgatgccatggaagagtggggatgaggatgctttcatggttgtatggcgtctcatcctcccgct

SEQ ID NO: 99620 - DNA, 440 bp, Homo sapiens
ccatacaaagaacacttgaggcatttcattcttgcaaacgcagctgagacagggccggcagtacacacctttcaatgaatagaaactttaaaatgtactctgctagtgaatttgcgtgtttggaataaagtcagttggggcttggtaaaggagaaaaaaattgttgcattgataggatctgtagattttgttataaaagacagatatgtaaatgaaagtacattctgagaatctgatccatgctgaaactgagtaataaaaccagaactgtattgtttccaaagtctagttcagtgattcttctccacttcaagtggctacaaaccagaaaatctaattaacgatgggaggtgggagggatgagactgaagatttacaggagataaagatttatgaaaactcaatattcaggataaagaaagggggatagaatagctctt

SEQ ID NO: 99621 - DNA, 1011 bp, Homo sapiens
tagcttcactcaccctcagctctgccatccaggtggtttacctggtgggtttctggttactatgtccttcttgggccatggctgctgctcctgcctccatttaccatcaaaattgggcaaagtgataccaagagatgtaccagtcaatcaccaggacctccaaacccacaaatcccagggttgcagggataagaagcacaaataacacaagtggatcactgtgagcgatggtccacgctgcttttatgagctgtaacactcactgcgaagatctgcagcttcactcctgagcccagcgagaccatgagcccaccgggaggaaggaacaactccagacatgctgccttaagagctgtaacactcactgcgaaggtctgcagcttcactcctgagccagtgagaccacgaacccgccacaaggaagaaactctgaacacatcatctgaacatcagaaggaacaaactccagacgcgccaccttaacagctgtaacactcaccgcgagggtccgcggcttcattcttgaagtcagtgagaccaagaacccaccaattccggacacaccaggaccttccgctgctcgctcctcctcgtcccttctacccgctggggtcagcctcatcgaccccgtctcaactctgacacagtctctctctctctctctctctatatatatatatatatatatttttttttagatggagtctcgctttgctccccaggctggagtgcagtggtgcaatctctgctcactgcaagctccacctcctggtttcacgccattctcctgcctcagcgtcccaagtagctgggactacaggcgcccgccaccacaccctgctaattttttgtatttttagtagagacggggtttcaccgtgttagccaggatggtctcaacctcctgaccttgtgatccgcccgcctgggcctcccaaagtgctgggattacaggcatgagtcactgtgcccggccagggcagatattcttgtagaattttgtttcttgct

SEQ ID NO: 99622 - DNA, 277 bp, Homo sapiens
aggtgaaagaataataactagattgtgattatactacaagcaatgctacaaggtttagggagaaagattgagcacatctgggacaatgcagggaggctttgtgctagaggtaggcctgagccttgacgtagaggtagaatttcagccaggagaaggcattctaagcaaaagaaaccaggtaagcagagagaggtacggaggcaggaggctacgaggcagttcaggaaatagtggaaggtttggtgtggctggaacagagggtatggataggagaaag

SEQ ID NO: 99623 - DNA, 296 bp, Homo sapiens
gcatgcgccaccacactcagataattttgtatttttagtagagacgggttttctccatgttggtcaggctggtctcaaactcccgacatcaggtgttccgcccacctcggcctcccaaagtgctgggattacaggcacgagccaacgtgcccggccacacttacttctgtataagaatgaaaatcaccctgttaagtccctagcacaatgcctagcacataaaaaatatccaacaagtggtagccattattataatttctaaatgacagcctgatgcagtcagtgtaacatgaggc

SEQ ID NO: 99624 - DNA, 268 bp, Homo sapiens
gtaggggtgttgggttcatagactgagcttgaaaggaccttttgagaccatttgttccaagctattgttttacagatgaggaaactgaggcttagagcacagaagtgaccaacccaaggtttcaaagtgagttgaggacagagctgggctcacatccaggtctctgaattcccagtgtaggtctctgtgtttcgcaccagcctcccctaggtctaggggatatggtttcttgggaaagagacctcccagccccacactgctgtttcca

SEQ ID NO: 99625 - DNA, 176 bp, Homo sapiens
gaggggccgattaggagcatcggctctcgcgactatggaggtggagggcccccagcaggctttctgcgaggtggagacccaggaacgggggtgacagggcttggccccagtcccaaagcctcagaaccagggaagcaatggtgtgatcttcagtctaaggccaaaggcctgagaac

SEQ ID NO: 99626 - DNA, 436 bp, Homo sapiens
  misc_feature (436)..(436): n is a, c, g, or t
ccgcgtgtccgagtgcagcggatgagcatcctgcgagtgcctcactgtgtctgccctggaggtggctgtttaggggagcacgccggaggccactagggtggatgtgctgtgtgcatgcaagtgcccaccctacgttgtgtttcggggcacacaagctacctgtgcctaccgggatgagcatgcaagtgtcaccgctcccgccgggcgtgcttggggtgtgcttgggtctgcgtgaggctgtgtgtgtactgccgaatctctgaccaggagagccctgtttagcttacatagtgcacggggaagggcagactgaggggcctgtccgtgccctggtgagctgagagaggggcacggggaagggcagtcgtcggggcctgtccgtgtgccagcgtgggtggactccgggctggggaagcgacagggaatggtgtgtgcn

SEQ ID NO: 99627 - DNA, 448 bp, Homo sapiens
ggaggtgatgaggtcatgtaggggccttcacagatgggatgagggcccataacagagactggagggagcgcaggtgcctctccagccagacaaggatgtgagaaagtgccaactatgaagagcaggccctcacaagaccccgatcctgttggcacctggatcttggacttcccagcttctaactaagaaatacatttctgcggtttatacgttccccagtctaaggcatctttgtcacagcagcccaaacaaagtaagacactttatgcattagccatagccaggcacgggcactggagacccattagctagacctttcacagacgtgtggcttttgcctcactgcgccctggaaggggctgaggtcagacaggcaatacagaggcagactccatccacatgggcatcacggcgccaggcaactcttccacctctgggctgcagccag

SEQ ID NO: 99628 - DNA, 124 bp, Homo sapiens
tgttcaattcccacctatgagtgagaacatgcggtgtttggttttttgtccttgtgatagtttgccgagaatgatggtttttagatggagtcttgccctgtcgccacccaggctggagtgcaat

SEQ ID NO: 99629 - DNA, 406 bp, Homo sapiens
acacttcttacatctcattggccataacttagtcgcatggccagtgaggctgggaaacacaattttggttagcagctcaactatacaagggattctgctaattggtagacaaagagaagaaagctacttggtgtcaaactagcagtgtctcccataatgaaggctttgcaagcttccttatcttctgaggctgtataatgggaagattagcaacatatgcaacaaatgggaataaaaagaacacaattacagtaaactatagtaatagtattccattgaattgaaggaaaatgatagatttttccacctcaaaagacacagggatactttctaatgatttaatgtcattcacaggaaaagggtaatataccacatggtactacagaaacactttggctgagcccag

SEQ ID NO: 99630 - DNA, 563 bp, Homo sapiens
taacaagaaaaagccagataaactgcaacattataacttttcttaaacccatctgagaattcagtttggagggtgactaagcagcctgaaatccaagcaaagaccggcccctctgagaagagagaagatccacacattagctcccctttgggcagagcatgggtggtagaaacattgggtaccatattagtaggtaagaagtcaactaaaatttgtaatgatttggtaaaagctgagtatgggctacagtgacagtatagaaaccttgggatcccagacaccagggaagttcacacttagtagtagtttcttctccatggacttctgttgattgctcacaagaaagattgagtcacggagggagaacagaaagttctctagttggttaagaactgaaggatggaggaaattggtccctgccacaggagactcctcccctatggaaccaaagccatgagctattgaaggagaagcggccaactgagaggtagcaccacattgagggagcaccacagggagctgggggaaaggtcaaagacaacattctttctatgccagggaaa

SEQ ID NO: 99631 - DNA, 357 bp, Homo sapiens
gtgcctggaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtgagtttgttacgttttgtgtttgtaacagccgcttttgtttttcttaggatggtgctttctcagttccagaagtttcagagaggccctcctcagtgtttggaaattgcttctgggtatattgggcctctgcttccctagggggccaaatagcagc

SEQ ID NO: 99632 - DNA, 447 bp, Homo sapiens
agttttgatttgcctaggatagttttagctatatttattgtctagttgtaattactaatagcatctccattcacttccaaaacattctggttgagatgaaaacttacatagtcaccttcacatttgggtgttgttttagtgtttgtgacttctacaaaacactagtgtcattcttaaatctacttttgttactagctatcatgggatttgttaaggagtgatactgcggccttatgaagtttttgatataaaattaaaatactactttaaaaatttctgttactgtattgctgttagaataagaactaaattttgtatgatccttgaagaaaataagttatggaaaaatatgtaaatcagtggatgtttttgtcctccagtagtcttatttgcttataggatttaattcatgttcttcattagtttgctcctaccgcagctgtggta

SEQ ID NO: 99633 - DNA, 268 bp, Homo sapiens
tatcttactatatttgataatttatttcattcataaattatatcgcagagggagtttttatttattactgaaagataggcgagatcaagcaacatgaccaaggccagcaaattgataaggagagaaattattgcatttgaaatccaccttctaactctacaccctagcttcttaccaaaagaaatcaagataaacccctgaaagttaagcttccttgtaagggtcactcataggaaagtttgcaatttgcaggatgagtccactatag

SEQ ID NO: 99634 - DNA, 331 bp, Homo sapiens
gcattagggaagagggacaattcatagacaaagaacgtataaagaaaaacaggctgggcgcggtggctcacacctgcaatcccagcactttgggaagccaaggtgggcagattacgatgtcaggagttcgagaccagcctggccaacatggtgaaaccccgtctctactaaaaataaaaaaattagccaggtgtggcggcgggcgcctgtaatcccagctacttgggaggctgaggcaggagaatcgcttgaaaccagagggcagaggttgcagtgagctgacatcatgccactgcgctccagcctgggcaaacgagtgaaactccgtctc

SEQ ID NO: 99635 - DNA, 498 bp, Homo sapiens
gcagcagctgctgatttagagcacaaggtgaaggctcttcctgcctaatgacacatactcttgcataaatttttcctaggagaaaaggcactaattgtttgttccaatgattaacagaaagcttgtgacatttctcagattcatgagacccagatgagtcgaagctctgcctggtacccgactacagttgaatcactaaatgtttcaagtctcaatttcttcacctagaaaatgaagataaatacctgtctttcttaactcacagggttttttgtctggatcaaatggttaaactgttttatggtgaagcggctttatacattgtaaagtgatctgtaaatgttcaaatattattatccttgtgcgccgaatatttgttaatcagcactgcgcttagacttgtgagggacttgtgagcatgagatttggcccttggtgaccttgatgtactttgaaaattgtggggaaatacacataacagaaaatgtatcattttaa

SEQ ID NO: 99636 - DNA, 372 bp, Homo sapiens
tgcacatttcttataccccgtgcagagccatactgttttccatccttccagtgatgccaaggttcttcccagccttccagccctagagatgtcaggaagtaacacagtaaccctttttcccctctctgtcatgctggtgtgaacaagacctggtccctcctttcacattgctccctgtcttgtggaacacatcaagagtgctctagaaacacaggcaaccactaggctttgggtttccctagggaaatggaaaaggagataaggagagattccatggagctcaaacctgtttttctgtcctgcccagtcccatgtttattgcagtattattcatgatagccaagatgtaacaacctacatgtccatcaacag

SEQ ID NO: 99637 - DNA, 500 bp, Homo sapiens
cacctctggtctctttccctatctttcccagacaaccctgctcttgtcttatctgagtcaggcacctggccctctattcttggctggctttcctcaactcctctttctgtcctcattttttacattttccatccttcagcttttctcattcctctgctgccatcttccctagcctttctgggttatatttgcctcctttgcaaatataatacaggtccaggtctggagttccagccccaccctattccacacatcctcagctcctcgccctcaatctcggtatctttgagtcattttgaaaagcttgggatttcagaagggaacaggggctgggttgtgtattaaaggtcaggaaggtggacagagtggaaggctggggtttggaaaaagacctttggtgtgcgtgcactcccatatttgtctgtcattatcattattcctcatcttattattttcattttattaataaaaaactacgttgatgatcattaaaaaatatt

SEQ ID NO: 99638 - DNA, 433 bp, Homo sapiens
taacaagagcatgtacgtgtattgcctgttaagattaaaacaaaatttaaacaaagcagcagctatattttgttcatgttggttgtccatgtgtgtggcacatttcatggattctgtccttcctgtgttactattaccttcatgttctcaccatctccacaaggctttgccctgactaccttatttaaaattacaacagcccccaccctgacattccctgacctttttatcctaatatacctcttcttttcttttcatatcacttactgccttacaacatatataatttatttacttatccagttgatttttactttgtgtctctccattcccctctagagtggaagcagtgtggggtccgtatctgtttggttcactgatacatctttggcttccagaacagtgcctagtatacagtaggtgctcaacacgt

SEQ ID NO: 99639 - DNA, 491 bp, Homo sapiens
  misc_feature (483)..(483): n is a, c, g, or t
  misc_feature (485)..(491): n is a, c, g, or t
aatttttactgtttttaaagtacttatataatcagaagtgaagtacctgtacaatcacaagcatttcctgatttttctgatgccatttccctagatatccaaacattttctattataagacaaaagtctacctgggtacatcagaataaactatttaactctatggaatacacttggattttaaaatacaaaactggaaacagatccattggaacaattatggctaagcacaacctattcaggtttaatagaaatattaatacctgttactatgaataagataatcacattacaagtgaaaatagttttaattgaaatattgtagttttgatttggcactgtaattagcatctgtattttaaactttgtgactgctgtgaacattatttatggaaggtttatattaatataatttggtgcttgttgcttttatcaaatattggtgtctaatgaaataaagtgcaaagaacttgaagttctcanannnnnnn

SEQ ID NO: 99640 - DNA, 359 bp, Homo sapiens
tctgttcatcctttctcaggaaagcacctgatagcttttatccaaagatctgctgcaaaatccatttagctacagacaggaaatgcaaaagaaagattcctgtagcaacaacaccttgtaattatgaaatactttccatcacagtgcataacatatagcagatttactacaccaaaattctttgccgttagatcttggggtacagcagtgaaattttctctatctttaaaagaacatgtggtttaaacccctttcaggcattttaaatcctagccaaaggtgcaacaccgtttaccgactctgacaagccactctaaaagtgtgcttgtttgatggggccatatcagataatgtgatag

SEQ ID NO: 99641 - DNA, 282 bp, Homo sapiens
tcccagtaaaatgcatatgttattttaaaatcctaaaataggatggtcgtgatcacacctgtaatcccaacactgagaggctgaggcaggaggaacagttgagtcaggagttcaagaccggcctgggcaacatagcatggcctcctgtctacaaaaaatacaaaaattaacttggtgtggtggtgcatacttttattcccagctactttggaggctgaggcaagatgatcccttgaatctaggaatttcaggttatagtgggctatgactgggccactgctc

SEQ ID NO: 99642 - DNA, 373 bp, Homo sapiens
atgacagtttacaagtgccacggcaacacccggaagttaccctatatggtctaaaagaaggaagaaccctcagttctgggaaatccctgccctttcctggaaaactcatgaataacccatacttcgtttagcatagaatgaagaaataactgtaagtatactcagtcaagcagcccatgccactgctctgcctatggaggagtcattctttattcctttcctattctttttttttttttctttttcgagacagagtcccactctgttgcccaggctggagtgcagtggcacgatcttgactcactgcaacctctgcctcccaggttcaagcaattctcctgcctcagccttccgagtagctggaattacaggt

SEQ ID NO: 99643 - DNA, 720 bp, Homo sapiens
aagaccatgtattgtatgattccacttatgtgaaaagttcagaatcagcaaaccaacagagtcagaaggttgattagtgactacctgaggttggagcagtaggttgagggaaaataagtgagcagaaatggtggaggactgctaatgtgtacagaatttattttggggatgtcaaaaatgttctaaaattaaattgtgatggttgcataactgtgtgaatatactaaaaaccactgaattatacactttaaatgggcgaattttatggtatgcaaaatatatttcaaaaaagctattaaaatacataaaaacattttcagatatgcaagatttcaaaaaattaacctcccacttatcttttcacaataagctacttgcagatgtattctgccaaaagaagtgaataaaccaagcagggggggaaacacagaatctagaaaacaggagttttaacacagaaaagaggcaaagggaatttccagattaatggtgcagaaaagttcccaatgatagttgtgtagcaagcttagagacttacaagtaacagaaggacaaaatgcactaggaggaaatccccgagtagaaaaagaaaaaagaaacaaacagactacctaatgtttgcacatattgcaatgatttttattgttctttcagaaattctgagaatgaattcgtgataggtacctggaaaactaagaaacaaacaaacaatgaggcaac

SEQ ID NO: 99644 - DNA, 480 bp, Homo sapiens
aggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccacccaatgtttagcaagcctggggatgtgccacgtcccccagggatccagcacgcacccaaggagacactgtcccggcgaggagcctggagcctgggaaatacaaggcatcagactggtcccaagactctccccagcgctggggacaactgtctgcttatcttagtcccctgcgcccttttcaatccaaccctgggtcctgggcacctcatag

SEQ ID NO: 99645 - DNA, 259 bp, Homo sapiens
ttttttgtatgatgtgaaaaaagggttgaaattcattcttttctatatggatagctagctgtttcagcagcatttattgaaacaacaatcttttccctattagattcccttggcacttttgtcaaaagtgacaattgaccatatatgccttaatctatttctggaccctcacttcaattccattggtctacatgtgtatcctctcttgatactgtactctcttgattactgtagctttatagtaactctcaaaatcaag

SEQ ID NO: 99646 - DNA, 260 bp, Homo sapiens
atgtcagtgtatctgttcctggggaatccattttcacccacatatttccttgcacctttccaaagctcttaaaaaactgtccagaaatgagaaggccatttcctaaaagcctggccttctagggaatcatctggaaatctaggaccactataaaataacagcttcaataacagaagcagatctctgacttttttttttttcccagaaaaagaagtgctggtttatccaactgaaaagtgcttattaacaaactgagagca

SEQ ID NO: 99647 - DNA, 738 bp, Homo sapiens
agcgggtcgctcccatgtgcccctgccgggaaatggcggcggctgtgccagtgctcccagtacgcctcaggaattccgtgaagcaccgctgtgcgggaggtgggggccggcaataccacaataccactggcggggacaactgagaaggcaatgaccaggatatcaaggataactggggcgacagtgatgatgtgaaaagaaagaaagagaagtaaaactagaagtaaaggtttcagaaaagatagatcgataaataatcgatcgatagatagataatagatagatgataggcaggtagataaatagataatattatatacatgtatatgtatatgactcgagaaagccaaagagaaattacagcaactggaaaaaaaaaacctttaatttaaaaagatgttaggagaacataaagtgctaacaccaaagaacaattagcaaactcgaccgggactaaactaaagaaattccaggaagagtcagacttcaaaccagccaaaaagacgtttggtgtaatacagtttatggagccaaggctctgaacccactttggagagatggcttcctggattttgaaaagttactaaaaaataaaattacccaatatgaaaagtcactgtatatatgcaagtttggggtatccttagatggagatgtgtgcctttttttagaagttgatgacttgaaaaagattactgatgctctgcagtgacaaaaagaagcaagagaagcaaaaac

SEQ ID NO: 99648 - DNA, 209 bp, Homo sapiens
ctaagcttggaatcaggattccatcctgacttttaaaagtttgacactggatacattatttaacctctctgaacctgtcttgtcatctgtaaaagagaaataataaagccttccctttggaattgtgagggtaaaatgagctagtcgcacaaattaagtactcagtaacaaaagtacttagggattcaggagagaaatttttttttgag

SEQ ID NO: 99649 - DNA, 509 bp, Homo sapiens
cggacaggtgaaagtcagaggctgaaggggagggcaataggagcctccgtaagtagcggggggctcctcgtgatggctgccagtgctttgaggtcaccctgacggtcttgctgaacctttcttcgattttgagctgtagcaagctcctacgggaccttctctccttcactggggctcagcttgcaggggttctagaaatatctccacagatcgctcttcctcccggggcctcagtttcctcatctgcagagtgaggcctattaagccaggtgtactgactttattgttatttatttatttggagacagagtttcactcttgtcaccccggctggagtgcagtggcgccatctcggctcagtgcaacctctgcctcccaggttcaagtgactcttctgtctcagcctcctgagtagctgggattacaggtgccgccaccacacccgggtaatttttgtatttttagtagagacagagtttcaccatattggccaggctggtctcaaactc

SEQ ID NO: 99650 - DNA, 840 bp, Homo sapiens
acaaacatgttttccttctatgtaggcaaaatcaaattaaatttacagtgggatgtttgcttaagaaaaaaaaaacctgacccttacatataaatacaatgattgtcattttttttaataagcatttcagagggttctgttgtgtcaggtgctttttaaaaacagctgttgttgagtctaaatgacgtgcctgctactggctgaacagagaccatccgggtgaccatttctcctcaccaaagccatttattctcagagagtgactctgtacccacctgaacctctttgcaaactctcccctactttgcctcagccttagcaggtgcactcttaaccctttctcttcctcccttttcagcctcctgattaacgttctttattttgttttcccttggaacgatggcactttccctgctcctgtgttaatttctgttcttcttttctgtttccaccgtgccctgcccctgactccttgctgcacagagcttttgtctcctggtgtgcagaggttgtcgtacctgcgcaccagcagcctcagccccacccacagcgactcccgccccaacccccctttccgacaccacttcattccccatatcaaaggtaaggaggcaggtttctccaggcagcaccctgcatagtggagatttattagcaccctgggaaggctaataaggtgtatctccaagagttagtgccgagcttttgagctctcagcatgcctgcgtgtgtcatgactatacccaacagttgtcttagaacgggcatagcatctctcattgggagaaatatgtcacttctaagggctctagatgaagaagcaggaagtatgtttaagac

SEQ ID NO: 99651 - DNA, 310 bp, Homo sapiens
gaaatttgcctcctaatgtgctttacaaatttttccttggagtatttgtaatttgtaattattttcatatgttatattacccatttacatatactggctattaaagtgtcacaaatgtttttcctaatttgattaacatgttatattgttgttaaacagaaattcttcaaattataatttaatagacttttgttttatgctttactgcatatttagaaatattttatattttaatttttacatttaaccataattgtgatttattttagtctataacgtgaggtgaggacctaaccccatcctcagcctt

SEQ ID NO: 99652 - DNA, 438 bp, Homo sapiens
aataaggttagaagctcttctgccctctaatgacccaacttcacctcttgtcacatcccccacttacctgaggcttcagccaaacaagatgtcttcaagttcctccttcaagggctatgctatctctctggagggcaggagtggctctgcccagagagcctcccttccttactctcttccattctacccaactaactcctcctttggggtccaatctgagctgagatataattccctcctagagcccttcctcgacctctcctctgcacactttcataacacggagatttactcctttgtagcctttttcatcattgtgttaaaattgcctgggtattcattaactctttcccgtttcaaaattttgcagaccaaaaagtgttgaatgagtgaatttagtgaaagtgataatgacctaatgtttggcatgagtagctg

SEQ ID NO: 99653 - DNA, 427 bp, Homo sapiens
ttttatgctcccatggcactcattacacactgtgactctgtttttgtatctttgtctcctctaccagaccgtgagcacctagccaagtaggccctcagggtttgtagaatgaatgaatgaatgtttccaccaccccagcagacttatctgctttcatcctgaaagaggtatcaaaccaagattttgtagcttcccccagttagctgctgaagtattatatcatcctcacaagtgagacagtcatccttatgtattaatcacccagcaaattcatgtattatataccgtctgtcatgacactatcgctggttttatttgaacctacttactcctgctaagtctctcacaggaaccttactcattatcactaaacacaacgatcatctcaagtactgtgcaccaggcagagcggaaggccctaggaata

SEQ ID NO: 99654 - DNA, 313 bp, Homo sapiens
taggaatatatactggaaagaagtagacatgaaagaatgaagtggactcgtgtgtaccagtaccaaaagatagctattacatattgctgagtaaaagtcaaaaacagcacatctagtatgatcccatttactagcaggcgtgtgtatgtgtgtgctttaaaattttaataagaatagggaaaaaggcctggaaagataacacagcaaactgttaatagtggttaattctgaataatggtatttaaagggtgttatttgctttttactttgctttttattctgtttgttttattttgtgtcatttggttttaaa

SEQ ID NO: 99655 - DNA, 238 bp, Homo sapiens
agtttgagaccagcctgcgaaacataacaagactctgtatctacacacacaaaattttttttaattagaggctgaggcaggagaattgcttgagcctgggtggttaagctgcagtgagctacgactgcaactgcattctggcctaagtaacagagcaaaagcctgtctcaaacaaaaacaaaaaaaccccaaatttgcaattagttaaggaagagaacctttgtttaaaaatttgggg

SEQ ID NO: 99656 - DNA, 2825 bp, Homo sapiens
tctttaaaactatttatggaatgaatgaattctttactgccaacatgtttcagtggggtggtggtgcagggttgggggtagagaaaatatgaatatgcaaagagaaaaaggagcttatgtgcaaaggaaggaggtgggggtcaccagaaggcagaggtcgctgaaggcaaactcctctggggacagctttgcaaatggccagtcccttttaaaggcatattaagtcttcaggtaactaattgacagctgtaatttaagatgtgttgacacacttgatgtgcttgccaaagtcatgcttaatgacttgtatctcacacaatgaaatagggcaaagttaaaaactcaaattgctttgagtttgtattggcttctggatcctgggttacatcattcttattttcatgttaaacattaacagcaataaaaaaacagaaaaagaaaggtggtgcggcagggagtggggggcagtcatgtaggggaggatattttgattgaacacaggcttgacagaatcttcttttcttcttagaaatcctagaaaacagaaagcaacaggaagatgtcttattgggaactacccccatcaacttcaccatgagtcaaacaaggaagaaaacttcctcagaaggagaaactaagccccagacttcaactgtcaacaaatttctcaggggctccaatgctgaaagcagaaaagaggacaatgaccttaaaacaagtgattcccaacccagcgactggatacagaagacagccacctcagagactgctaagcctctcagttcagaaatggaatggagatccagtatggagaaaaatgagcatttcctgcagaagctgggcaaaaaggctgtcaacaagtgtctagatttgaataactgtggattaacaacagcggacatgaaagaaatgggagaagcatttgagatgattcctgaacttgaagagctaaatttgtcttggaacagtaaagtgggaggaaatttgcctctgatccttcagaagttccaaaaagggagcaagatacaaatgattgagcttgtggattgctccctcacgtcagaagatgggacatttctgggtcaactgctacctatgctgcaaagtctcgaagtacttgatctttccattaacagagacattgttggcagtctgaacagtattgctcagggattaaaaagcacctcaaatctgaaagtactgaagttacattcatgtggattatcacaaaagagtgtcaaaatattggatgctgcttttaggtatttgggtgagctgaggaaattagatctttcctgcaataaggatctaggtggaggttttgaagactcgccggctcagttggtcatgctaaagcatctacaagtcctagatcttcaccagtgctcactaacagcagatgacgtgatgtcactgacccaggtcattcctttactttcaaatcttcaagaattggatttatcagccaacaaaaagatgggcagttcttctgaaaacttactcagcaggctccgatttttaccagcattgaagtcattagttatcaacaactgtgctttggagagtgagacttttacagctcttgctgaagcctctgttcacctctctgctctggaagtattcaacctttcttggaacaagtgtgttggtggcaacttgaagctgcttctggaaacactaaagctttccatgtctcttcaagtgctgaggctgagcagctgttccctggtgacagaggatgtggctctcctggcatcggtcatacagacgggtcatctggccaaactgcaaaagctggacctgagctacaatgacagcatctgtgatgcagggtggaccatgttctgccaaaacgtgcggttcctcaaagagctaatcgagctggatattagccttcgaccatcaaattttcgagattgtggacaatggtttagacacttgttatatgctgtgaccaagcttcctcagatcactgagataggaatgaaaagatggattctcccagcttcacaggaggaagaactagaatgctttgaccaagaaaaaaaaaagaagcattcactttgaccatggtgggtttcagtaaactgatttcccatgtcctactaagctacaaaccattctccaaaggaaaagaacatgaacgaattccagagtcatgaactgaatttcaacttctgggccatttaatgggacttatattacaagagctttgtaaatatatatatatattacatatatatatgtaatatacatatatacacatatatataatatacatatataatacacatatatatgtaaatatatatataatatctaatatgagcatgccattattctctgtctatgaaacaaaaatggcatttttcaatggatttgttttggatatataattagttcatttgctgtttagaagccttgccaaaagtgtttagattttggtactgcaactgctttcctcttgcccagaaatgttttgcctcttcttttcctacaagttaaatgttctaaatataaaggggtatgtgtgtgtgtgtgtaattctaatgtgaaaggcactagctgtctaatagtttcatgtatcattactattactatatgtatcttaatgtagtctatgtaggtttttatcagaaagtgtacctttctatggtttattattttatattctggtgccttttatctcagatataaaccatgaacagtaatgatagtcactgacatataaatcttagtaaaaagtgattaaaaatctaaaactcagtatgaaaaacatatcttgttagaataaattaaaaccttttattgtttaaaaaattgtt

SEQ ID NO: 99657 - DNA, 1751 bp, Homo sapiens
tctttaaaactatttatggaatgaatgaattctttactgccaacatgtttcagtggggtggtggtgcagggttgggggtagagaaaatatgaatatgcaaagagaaaaaggagcttatgtgcaaaggaaggaggtgggggtcaccagaaggcagaggtcgctgaaggcaaactcctctggggacagctttgcaaatggccagtcccttttaaaggcatattaagtcttcaggtaactaattgacagctgtaatttaagatgtgttgacacacttgatgtgcttgccaaagtcatgcttaatgacttgtatctcacacaatgaaatagggcaaagttaaaaactcaaattgctttgagtttgtattggcttctggatcctgggttacatcattcttattttcatgttaaacattaacagcaataaaaaaacagaaaaagaaaggtggtgcggcagggagtggggggcagtcatgtaggggaggatattttgattgaacacaggcttgacagaatcttcttttcttcttagaaatcctagaaaacagaaagcaacaggaagatgtcttattgggaactacccccatcaacttcaccatgagtcaaacaaggaagaaaacttcctcagaaggagaaactaagccccagacttcaactgtcaacaaatttctcaggggctccaatgctgaaagcagaaaagaggacaatgaccttaaaacaagtgattcccaacccagcgactggatacagaagacagccacctcagagactgctaagcctctcagttcagaaatggaatggagatccagtatggagaaaaatgagcatttcctgcagaagctgggcaaaaaggctgtcaacaagtgtctagatttgaataactgtggattaacaacagcggacatgaaagaaatgggagaagcatttgagatgattcctgaacttgaagagctaaatttgtcttggaacagtaaagtgggaggaaatttgcctctgatccttcagaagttccaaaaagggagcaagatacaaatgattgagcttgtggattgctccctcacgtcagaagatgggacatttctgggtcaactgctacctatgctgcaaagtctcgaagtacttgatctttccattaacagagacattgttggcagtctgaacagtattgctcagggattaaaaagcacctcaaatctgaaagtactgaagttacattcatgtggattatcacaaaagagtgtcaaaatattggatgctgcttttaggtatttgggtgagctgaggaaattagatctttcctgcaataaggatctaggtggaggttttgaagactcgccggctcagttggtcatgctaaagcatctacaagtcctagatcttcaccagtgctcactaacagcagatgacgtgatgtcactgagtaagtatatattgcagagcaaaggaaagacttttggaatcttggcctatatttggaaacttggaaattttaatatgtacacttaaatttacttcttttgaagttattggaaagatcaattcataacagttctgtgagtgccccaatgtagtacttggcatgtattaaacgcccagtaaatgttagtgaatctcagttccacccatacatgtctgcaaatgatagatttggcacttagggaaaattttgaatttatgttgctgtttagaaataaatctcttagtgtcacaaagttgattacaaacaggttacatacctgtaaccaaacgtcaac

SEQ ID NO: 99658 - DNA, 1499 bp, Homo sapiens
tgacagattaaacagattgtgggaaccaaacacccagaagactccctgtgagatggtgcctaaaacatgtcactgttgatatttttaacagcccaggtcattcctttactttcaaatcttcaagaattggatttatcagccaacaaaaagatgggcagttcttctgaaaacttactcagcaggctccgatttttaccagcattgaagtcattagttatcaacaactgtgctttggagagtgagacttttacagctcttgctgaagcctctgttcacctctctgctctggaagtattcaacctttcttggaacaagtgtgttggtggcaacttgaagctgcttctggaaacactaaagctttccatgtctcttcaagtgctgaggctgagcagctgttccctggtgacagaggatgtggctctcctggcatcggtcatacagacgggtcatctggccaaactgcaaaagctggacctgagctacaatgacagcatctgtgatgcagggtggaccatgttctgccaaaacgtgcggttcctcaaagagctaatcgagctggatattagccttcgaccatcaaattttcgagattgtggacaatggtttagacacttgttatatgctgtgaccaagcttcctcagatcactgagataggaatgaaaagatggattctcccagcttcacaggaggaagaactagaatgctttgaccaagaaaaaaaaaagaagcattcactttgaccatggtgggtttcagtaaactgatttcccatgtcctactaagctacaaaccattctccaaaggaaaagaacatgaacgaattccagagtcatgaactgaatttcaacttctgggccatttaatgggacttatattacaagagctttgtaaatatatatatatattacatatatatatgtaatatacatatatacacatatatataatatacatatataatacacatatatatgtaaatatatatataatatctaatatgagcatgccattattctctgtctatgaaacaaaaatggcatttttcaatggatttgttttggatatataattagttcatttgctgtttagaagccttgccaaaagtgtttagattttggtactgcaactgctttcctcttgcccagaaatgttttgcctcttcttttcctacaagttaaatgttctaaatataaaggggtatgtgtgtgtgtgtgtaattctaatgtgaaaggcactagctgtctaatagtttcatgtatcattactattactatatgtatcttaatgtagtctatgtaggtttttatcagaaagtgtacctttctatggtttattattttatattctggtgccttttatctcagatataaaccatgaacagtaatgatagtcactgacatataaatcttagtaaaaagtgattaaaaatctaaaactcagtatgaaaaacatatcttgttagaataaattaaaaccttttattgtttaaaaaattgtt

SEQ ID NO: 99659 - DNA, 516 bp, Homo sapiens
ggcaacttagtgattgggcttgtgtgtgtgtgtgtgagcgagctggatgtcaggcagtgggtaaagtagtgaactggaggtgagaaaacaatgacacaaactcagggcttctcttcccaagtatttggctgagaagagagatgtagtattaaagggagatatgtggtaaaggaagacttttattccaagattcaacaaaagcgtgagtatacttctatgttaaagggaaagagccaacagagaaaacacatttttgaggttagaagagaaggaagaactaatgcagaagggccccaaaaggcacaggtgcctgcaatctggatcagggacagattagctttggactcctacaaaagcaagaagggagaaaggaccatgtgactctagagatatttctggtaaaggaaaggtttaggaaaagatcttttgatgacctttattttaacagactttttttttctttttgagatggagtcttgctctgtcacccaggctggagtgcagtggcacgatctc

SEQ ID NO: 99660 - DNA, 162 bp, Homo sapiens
cagccacccgagcgtgtagaaattaaacaaaaccttctagaaatttagccccaggctatggataagatacatttattaggttaacttctagtttgattaactctaaattcttcctggaaaatacaaaatactgattctgcctattaggcaggtagcaaatta

SEQ ID NO: 99661 - DNA, 488 bp, Homo sapiens
aaggggctgagggacttttgtgagaccacgcggcaagctggggcctggaaacatgagctcatccatcccggcctttctgctgtggctctatcatccacttgtccagggagggtgccagccctacgtgtgtttagtgagaagtgtggggtgagagcaaccacaggaaagaaagccccgttgtgacaacgttgtgccctgagctgcctggcccactcattccactggcctgtgttctacccaggacgggccgcatgtcccagggtttctgctgagcaaccagtcagcgtgctgctgagcacccgggcccgatgtgaaatggtcagctcctttccttctaccagtgccaactgctgcacctgccagcctctgcctagcctccaccactgatgctgctgtaagaggaagaagattcctgtcttaacagaattctcatgcatgcctttcaaaccgaggagctcacaggctgacggaagaggatgacagggagt

SEQ ID NO: 99662 - DNA, 412 bp, Homo sapiens
gaccttgtgatccacctgcctcggcctcccaaagtgctggggatactgatttttttaaaaagatagccaagctgggttctcctgaccttaattcaaaatccggtttctccagctctattgctatttgtaaaagaagtagtagtagtaataatagcaatagcaaggataataagtgactagggtccataccctaaaaatagagtaatgaataagatacaatattcacaaaatgttaaacccatctgttatacaggtaagcttaagtgatgtatccaaaggcacccatctggtcaatggcagagggaagattagaggccaggtgccagctctccctaaaacaccgcatactttccttccatggctggtcttccaggctttctttggtggtctgagtgctagagagcaagaagga

SEQ ID NO: 99663 - DNA, 793 bp, Homo sapiens
agacagggtctcactctgttgcctgggctggagtgcagtggcatgaccatggctcactgcaacctctgcctcccaggttaaagcaattcttgtgtctcagcctcccaagtagctgggattacaggcatgcgcctccacacccagcttatttttgtatttttagtagagaccgggtttcaccatgttggccaggctggtctggaattcctgacctcaggtgatccgccagccttagcctcccaagtacaggtgtgaaccactgcattccgccctcttcctcaatttaaactgagaagacagttcgagctaatgattcttagattttatgtatatataaatatatcaaatctatatattatttattatatctatatttatattattgtaaatatatgttagatctctcatatgtccaagtaatctgttggtttgcacgatgaatgtctacattacaaaagtcagctgaactgacaaacctcttataattggaacaatggttgaaatgttttcccattagacgttaggtgggttcacagctctgctagagtcaagggacatagtttagcgctatggacattttacttatgactcattcaacataaaactgtagtatgtcattatgtccattttctcaaaagagaaatgttaaatgtaatgaaaaaaataatatagataccattgaattattcaaatgaatgatgctagatacaaagaattccaaatttaaaagggggtagttaagagagtgttcaataattgtgtatagagatcagtcagtcattgttagggagtt

SEQ ID NO: 99664 - DNA, 798 bp, Homo sapiens
ttttgcttttcttttcttcaggcatacagcaaaactagaaggaactggaataaaatgaaaatgcctaatttctgggacaaggctctagtaaagtcctgcctctggcagatgaaatttgccatagagaaggtgctggacaatactcagaagtattactcttccctgcttcatgccagagctgcagaggaatttttattaaatcttcacaaggaaaacttgatgaggcctctggagtcgaaattccacaaaactgttggggttgtctaaaaatacaaccctcaggacagtatttatcttaatcaattgtcctctcaagttccaataacccaacaaaattcccatttaactgttcctacctgttcacagcttatgatttctattcctgggaagcaattttgggctgtgattctctggatttacccattttctgcaatttggagtggttgtttgccctgtgacctctattccctgaagagtcttagtaaaatccttaattttagtttgttctgcttttatttgttgtaaggactttcttataacccttgaaaactgtgatttccatgctatttacatgctggaactaaaacctgaaattcatagcttacagttataagccacctaagctccactaatattattaaatatcttttcaactttcttgttaataaatagatgtatgtattactttgaatgattatataagtgagttactgacagcctttacgattaatttatccaatattctaataacttccaaatttcaatctgtttctctgctatacattttattatatcctc

SEQ ID NO: 99665 - DNA, 600 bp, Homo sapiens
ctctaatgatggggacattccttagctgcacaaacagtcctgaaggctgtacagctaggtctgaacctgtccacgagccccttttgtgagctgggtgggttgccctgttgagctgctttttagaagccttcatccatcaaggcaggccagggggcaagctgcctctggagtgccggcaccttggatcctggtatctgcccatcctgcctgcaaggccctcataacttgccctcagccaccccaggcagccctgtctctagtaacaatttttgtcttgaagtctatcttgtctgagaagatcccactctcctctggtcactgcttgcaaggaatatcttttgttattttttaatttttttgagatggagtttcgcttttgtcacccaggctggagtgtggtggcgcgatcttggctcactgcaaattctgcctcctgggttcaagtgactctcctgcctcagcctccccagtagctgggattaacagggctcccgccaccacgccagggctaattttttttttttgacggagtttcagctcttgttgcccaggctggagtgcaatggcgcaatctcggctcaccacaacctccacctccca

SEQ ID NO: 99666 - DNA, 669 bp, Homo sapiens
cggagctgtcatctcctgtaacaatgccttcttctcacagacctcctgaagggcctgccttatgctgtttcacagttaacttttttttaagtagaagtacactctaaaataatgacaaaacatatagcacagtaatgcataaaccagtaacctagccatttattaagtactatataccttacatcattttatgtgctagatttttatatgactggcagcacaggtttgtttataccagcatcaccataaacaacatgattatcgtgttgtgctaccttatgatggctatgatgtcactaggtgataggaatttttagctccattataatcgtatggcaccaccaacatatatgcagtccattattgactgaaaagctgttatgtggtacatggctatatttcgaaacagggcctttaaagaggtaactaaggttaagtgaggtcataagggtggggccctaaagccaataggattgatgtccttataagaaggggaagacacaccagggatacaagtgcacagaggaaaggccatataaagacagtgagaaggtgccatctgcaagtcaaggagagaagtctttgaagaaaccaaatctgctgataccttgatcttggattttcagcctccaacactgtgagaaaataaatttctgttgtttaacctga

SEQ ID NO: 99667 - DNA, 1235 bp, Homo sapiens
cggagctgtcatctcctgtaacaatgccttcttctcacagacctcctgaagggcctgccttatgctgtttcacagttaacttttttttaagtagaagtacactctaaaataatgacaaaacatatagcacagtaatgcataaaccagtaacctagccatttattaagtactatataccttacatcattttatgtgctagatttttatatgactggcagcacaggtttgtttataccagcatcaccataaacaacatgattatcgtgttgtgctaccttatgatggctatgatgtcactaggtgataggaatttttagctccattataatcgtatggcaccaccaacatatatgcagtccattattgactgaaaagctgttatgtggtacatggctatatttcgaaacagggcctttaaagaggtaactaaggttaagtgaggtcataagggtggggccctaaagccaataggattgatgtccttataagaaggggaagacacaccagggatacaagtgcacagaggaaaggccatataaagacagtgagaaggtgccatctgcaagtcaaggagagaagtctttgaagaaaccaaatctgctgataccttgatcttggattttcagcctccaacactgtgagaaaataaatttctgttgtttaacctgagtaggggttgtgttttctattcccatttgctgcaaggtatgtttaccaaaggctgtttgagtttgtgactgtagtgggtcaaatagtgttccccagtaatttatgtccacctgcaacctcagaatgtattctcacttggaaatcatgtctttgcagatgtaataggtaagtattgagataagctgatattggatatgagtaggttctaaatccaatgacagtatccttataaatgacagaaaaggacacagagacagaaggccatgtgacgactaggcagagattggagagggagcatggccctgctgacgccttgattttggatttctagccaccggaagtgtgagagaataaatttctcattttaagccacttgtggagtggtaatttgttacaactgctctaggaaacaaatacagttaccaaacaaactgattatgccaggtgaactttttatgatgataatatgagccaaggacgcaagcgtgaagagttctagtttctgttaaagccaagttaaatactttggaaagactagataaaagtttgttgactttaaaaattta

SEQ ID NO: 99668 - DNA, 319 bp, Homo sapiens
ttttttttttggttgcagacatttaaataatctatatttgtagggtgatatcttggagattactttactatcaatatatagaagtaataacctggtagatagcattacctatgaaaggtccatcccatctgctattcttgctgaaagcttttcatgcaccagtaaactcagtaaatatcagaagataaagcataagcctaccacgccacggatttactcctaatgtctcctcaaagtgcagcccgatgcaacgattacaaatgattttcttctaatgtcattttacataacccttttttctgcatgagtagttagtgtg

SEQ ID NO: 99669 - DNA, 307 bp, Homo sapiens
ctttaataaatgtttttgagaaaattggatatctatatatagaagaattaaattgaaaccttttctcatatcatgtgaaaaaattaactcaaaatgggtcgaagacttaagcataaaatctgaaactgtaaaactactagaaaaaaacatagggagaaaactacatgaaattggtttgggcaattacattttcaattttactctacaaccacaggcaacaaaagcaaaaagagatgaatgggatttcatgaaatatgaaagcttctgtataacaaaggaaacaacagaaacaacctacaaattagga

SEQ ID NO: 99670 - DNA, 1078 bp, Homo sapiens
  misc_feature (543)..(543): n is a, c, g, or t
aacacaccagcatcactttagctccatcattgctgtaggtaaatgagcctcctttccacctaaaaatgccctgcaacccttttctgaaatttcttagacagttattcatctttaaaggattattttcttctgcaaaagtttttgcctttttgttttaacacttagaaattaacatctagaggccaaaattcagaggaaaatggggacagcctatgagtaagtttctaagaacgcatggtgggcagtgaacatgtgaaacagttatgaggcagatctgctagcaggtgggtactgttgaagcttgaaagtagaaatactttggttgttttccacaactcctacttggtggtggaagcaggaggcagggggtgatttgtccttctgttcttagttcagtccttagaccagatacgatgagattcaaaggttggcccttttaaaagaaatctttttgaaaaaaaaaagttaaggatttcatggggggatgctggttagaaaggaagagttaagccactaaaatcacggcccctgggattgtttttnaccaccaaatgctttctgaaactcacataattgatgcagttccaatgatttatttaaatacaatctgagtgtgagaatggtggtcaaaatcctggtggttaactaattttgtcaattaagacagccttgtaaataagtacaaagaggagctgatgaggctccagagacccctgggctcaaaataaatggaaccgacatcattattatggggaaggagctttttgcaaatctgaattagtgattacaaatatgctaagagactaagagggcctaatgagaaaatgctgcctgatttttaacaggtgcagttcagtgttaattattgattccaacatttcgctagatgaagagcacctatgttctaaaagcaaaatgaggactcccagcagaaagcctttagcctgcccctgtggagtgcagatgaccaaagtgattttgttgtatcacgctgagccgtttctggagggaaaaggaaatggaatttcagtgtgtgggacaaaaacctaaaatatattttgctttaccaaaaaaaaaa

SEQ ID NO: 99671 - DNA, 479 bp, Homo sapiens
tggagggagctgtgccgttggtagaaactgcttttttcttccttaacagtttaaatctgtcgtccattctccgtgaagtgattggacggggcaagactcaggtttcccatctgttctctgtttgcatttgggcgccatttcaaaaaccacacgggaaaagtttataggcaaatctgaattagtgattacaaatatgctaagagactaagagggcctaatgagaaaatgctgcctgatttttaacaggtgcagttcagtgttaattattgattccaacatttcgctagatgaagagcacctatgttctaaaagcaaaatgaggactcccagcagaaagcctttagcctgcccctgtggagtgcagatgaccaaagtgattttgttgtatcacgctgagccgtttctggagggaaaaggaaatggaatttcagtgtgtgggacaaaaacctaaaatatattttgctttaccaaaaaaaaaa

SEQ ID NO: 99672 - DNA, 3975 bp, Homo sapiens
  misc_feature (1138)..(1138): n is a, c, g, or t
atgcatagagctgttctaattaatggagagacaattcacagttcatttattcattgactcaacaaatatttatggaacaacaaatatgtgttgttttaggcattccgagatcaggaagtaaaaaatataaaaatctctgttatcatggaatttacagtctaatgatcaaagggaggcaataaataaataaatttatttatttaaaaactgtattcaaagagtgataagtgataagaagaaagatgttagggaagtgggaggagatataaatgtactacaagactggtcaggaaagaccacacaaaaattgagtaaacacacaaaaggtttgaagaagtaatcaaaagagaatacagaggaagtgcattccatccagtgggaaggggaagaacaaaggatctgaggcaggaatgcaatgtaatgactaattactatttgtgaggctctggtccacatggatgaggaaaaatcatgcctgttttgttgaaactccaaatctggttggggaagaagttactaatcaaataaccacccaaataaatacataatcatatataatgataaattgataaattctgtaaagggaaaatacaggtcactatgaggaggtacaatgcaaagttctgagtgattctgaagagtcaaaaatatcttccctgaatagttgatacctatattgagatctgaaggctgcatagaatttaaccagataaaagagaaaagaaagcactccaacatcataaccagcatgtgttagttaaaagtgatgctgagaaagagcttgagttagattgaagtagaatcagtgatagaaaataacagccgaaaacaaacaaaaaggggacatagtgacaatttctcctgggttattttggctggaaccaacttccattatccagaagctgataaaaaagctttgggaaacatgaacaaaacattgatgaaatgttggaaaccagttgaaacacagtaaaaccaactgggtaaaataggaccacttctcttcatctacactgggatttgtcaagaagtgaactatgacaatacatcaatttttgctactgtttctattctgggtatgcctgccacatttctgctctccagaaataatgttcagaaggacgcctgtgccacagcnaagaattttaagttcacgtgtaccaaggagtgatggcaaaattctccatcgtcaaaaacgtggttggatgtggaatcaatttttcttacttgaagaatatacaggatctgattatcagtacgtaggcaagctacattcagaccaagataaaggagatggatcactcaaatatatcttatctggagatggagctggtactctttttattattgatgaaaaaacaggtgatattcatgccacaaggcgaattgatagggaggaaaaggccttttatactctacgcgcacaagctattaacagaagaactctgaggccagtagagccagagtcagagtttgtgatcaaaattcatgatatcaatgacaatgagccaacgttcccagaagaaatctatacagctagtgttcccgaaatgtctgttgtaggtacttctgtggtgcaagtcacagctacagatgccgatgacccttcatatgggaacagcgccagagtcatttacagcatacttcaagggcagccctatttctctgtggagcctgaaacaggtatcatcaggactgctttaccgaacatgaacagagaaaacagagagcaataccaagtggtcatccaggccaaagacatgggcggccagatgggaggcttatcggggacaaccactgtgaacatcacgctgacagatgtcaatgacaacccaccacgtttcccccagaacactattcatcttcgagttcttgaatcctccccagttggcacagccattggaagtgtcaaagcaactgatgctgacactgggaaaaatgctgaagtagaataccgaattattgatggtgacggtactgatatgtttgacatcgtgactgagaaggacacacaggaaggcatcatcactgtgaaaaagccactcgactatgagagccgaagactttatactctgaaagtcgaagcagaaaacacccatgtagatccccgtttttattacctaggaccatttaaagatactaccatagtgaaaatctctatagaagatgtggatgaacctcctgtttttagtaggtcctcctatctgtttgaagttcatgaagatattgaagtgggcacaatcattggtactgtaatggcaagggacccagattctatttccagccccattagattttccttggatcgccatactgaccttgacagaatctttaacattcattcaggaaatggatctctttatacatcaaaacctcttgaccgtgaactatctcagtggcataatcttactgttattgctgctgaaatcaacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgcttctgttaggtacatgtcctgcccttgcaaatgaagcttttaaaaaggtgaagaaaaattttacagtatatcctgttctgtacattaaattaaaaaaacaaaaatgtacatgtgatgttagtaggtgtgatatgcaacctggtatacagacatttgtgcaatttcatttcatcaaattctatctgctaatgttttatatttatatttttgtatttatttttaaaaaaataaaccagtttttacaactaaaaagtct

SEQ ID NO: 99673 - DNA, 3270 bp, Homo sapiens
  misc_feature (433)..(433): n is a, c, g, or t
gccaatcagagagagctcgcccccgttttcttcggttccctgctgtccagagttaaaagtgatgctgagaaagagcttgagttagattgaagtagaatcagtgatagaaaataacagccgaaaacaaacaaaaaggggacatagtgacaatttctcctgggttattttggctggaaccaacttccattatccagaagctgataaaaaagctttgggaaacatgaacaaaacattgatgaaatgttggaaaccagttgaaacacagtaaaaccaactgggtaaaataggaccacttctcttcatctacactgggatttgtcaagaagtgaactatgacaatacatcaatttttgctactgtttctattctgggtatgcctgccacatttctgctctccagaaataatgttcagaaggacgcctgtgccacagcnaagaattttaagttcacgtgtaccaaggagtgatggcaaaattctccatcgtcaaaaacgtggttggatgtggaatcaatttttcttacttgaagaatatacaggatctgattatcagtacgtaggcaagctacattcagaccaagataaaggagatggatcactcaaatatatcttatctggagatggagctggtactctttttattattgatgaaaaaacaggtgatattcatgccacaaggcgaattgatagggaggaaaaggccttttatactctacgcgcacaagctattaacagaagaactctgaggccagtagagccagagtcagagtttgtgatcaaaattcatgatatcaatgacaatgagccaacgttcccagaagaaatctatacagctagtgttcccgaaatgtctgttgtaggtacttctgtggtgcaagtcacagctacagatgccgatgacccttcatatgggaacagcgccagagtcatttacagcatacttcaagggcagccctatttctctgtggagcctgaaacaggtatcatcaggactgctttaccgaacatgaacagagaaaacagagagcaataccaagtggtcatccaggccaaagacatgggcggccagatgggaggcttatcggggacaaccactgtgaacatcacgctgacagatgtcaatgacaacccaccacgtttcccccagaacactattcatcttcgagttcttgaatcctccccagttggcacagccattggaagtgtcaaagcaactgatgctgacactgggaaaaatgctgaagtagaataccgaattattgatggtgacggtactgatatgtttgacatcgtgactgagaaggacacacaggaaggcatcatcactgtgaaaaagccactcgactatgagagccgaagactttatactctgaaagtcgaagcagaaaacacccatgtagatccccgtttttattacctaggaccatttaaagatactaccatagtgaaaatctctatagaagatgtggatgaacctcctgtttttagtaggtcctcctatctgtttgaagttcatgaagatattgaagtgggcacaatcattggtactgtaatggcaagggacccagattctatttccagccccattagattttccttggatcgccatactgaccttgacagaatctttaacattcattcaggaaatggatctctttatacatcaaaacctcttgaccgtgaactatctcagtggcataatcttactgttattgctgctgaaatcaacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgcttctgttaggtacatgtcctgcccttgcaaatgaagcttttaaaaaggtgaagaaaaattttacagtatatcctgttctgtacattaaattaaaaaaacaaaaatgtacatgtgatgttagtaggtgtgatatgcaacctggtatacagacatttgtgcaatttcatttcatcaaattctatctgctaatgttttatatttatatttttgtatttatttttaaaaaaataaaccagtttttacaactaaaaagtct

SEQ ID NO: 99674 - DNA, 406 bp, Homo sapiens
gttttgacctagagttcctacaagttgagatcattttaaatctggagtctgtcatcctatatattgaactacgccacccagctttgcgatatctgcaatgcaaaaagcctgtctttgtgatcaattatgatcaacaatctgcttctttagggcaggggccctgatctggacagctgtgtattcctcacagtgcttagtagggtgccctctatatagtaagtgtctgttatttgttaaataaacgaatatttgggcagagccaaaaaacagttcctgtggcccttcactaaaaacattttcttccaggttgacattgaatccgctgatcaaccagctgtgaatctgcctaattactagttatgcagtcaaatttcacaatctatgcacaaggatattacagaagact

SEQ ID NO: 99675 - DNA, 222 bp, Homo sapiens
tctcttctcaggccagacagcatttccagacagcctttttactggaaggaggtgagtgttttctctgctcatggatcagatgtctttctcctgcctttcctaacaggcagctgtgcctggtgtctggaggatcaggctgccctggaatgcgagcaggagtgcctgggctaatggctatggttttgccagccccagagactgacaggcagttgttgtttttgt

SEQ ID NO: 99676 - DNA, 639 bp, Homo sapiens
ttccgataattactttagatactggggattcagtgatgaacaagacagaagctgtccctgctgtcatgagaaccgccttctagaagaagaataatacacaagtgagaaacacaaataatacacaagtgagaaatttgtggtttgtactgtgcagagaattaaaatggataaatggatagtgtaaggctgggcactgtaaggcttgtgcctgtaatcctagcagtttgggaggctgaggtgggaggattgtgtaagcctagaagtttgataccagcctgggcaacatagtgagaccccatctccaccaaaaatttagaaattagctgggcatgatgacgtatgcctgtgatcccagctacttgggaggctgaggcaggaggacttgagcctaggaggttgacgctacagtgagctgtgattgtgtcactgcattccagcctgggagacagagtgagaccttgtcttacgtgtacaaaaaaaaggataatgtggtagagactggtgactgctttcattaggcagtcagagatagcctaattgaaaaaggggaattttaattgagatcggaatggcaaaaggagccagctgtgtgaagatctgagagaagagctttatagatagtgagaacaagaaagacaa

SEQ ID NO: 99677 - DNA, 267 bp, Homo sapiens
gtccatttggtgtgtaatcctaaaattctgcattgctatagagcaagagcacttacgctgaaatccatgagctctttgaaattgtgtaaaatttggagagcttttacatctctcatttcactgtgtatctgattttcaaagagaaaaagtgttaaaaaggatagaaaacacaagcttagaacagtcactttaaagaacaaagttttaggcaaaaacactgagaatttcaactcggcttgttgggagttggccctcatttatatccag

SEQ ID NO: 99678 - DNA, 544 bp, Homo sapiens
ccgctgctctctgcagggctcacacctcctcatggttgcattcaaatgtcgtatctttctcaaaagcaggaccccttcttgccaccttccactggaccacccacctccaggggcccttctgtctgctcttttccccccacttctgtggtcctttcctgggccagatctccctccaagctgcacaacagccttccacggtgtgaaccctctgtggctccctattgccatcggcctaatgttcagggctgttccacaaactggacactgctggcttctcccacctcatctcttggggctccttcacacacaaggtatgccccaagctacaatatacctctcaggcacgacataaactttccaacctctgagctttcacttgcatagttcccttggcctagtatgtcgtgcacacacctccttgcatggcaaactcctatttgttcttcaaagcccagctcaaatattccctacttcaagaagtaccccctgatccccataggctgttattccttccttcctctaggtctcatcttcctggactgtg

SEQ ID NO: 99679 - DNA, 272 bp, Homo sapiens
tactctggtatgaggaccacaatttaaaatctatttcttactggacaaatgataggaaacaactgtattcggccactggacaataggcagcacagaactgtaatccctgagagaaagcaaataaacagagagagcccttaatgatggctcgatttctgcctgaaagcactttccagacagggagaggggtcccaagaagaacatgacagtctcattgagttgaaacaagagactgcagtttaggaagtctaaaacagccagaatttgtgagg

SEQ ID NO: 99680 - DNA, 744 bp, Homo sapiens
ctctggtgatcctcccatctcagcctctcaaagtgctgggattacaggcgtgagccaccgtgcccagccaggcaagccccctgattctcaacaagagggctgagcagtgtgaagataagatgcggctttggtccaaagtccagagtgcttcttggggctgaggggcgtagccattgcagtgcttttccaggggagaatgggttgggctccctctcctgagtcgggggacatgagcctagcgacactgctgtgcagtttgctcgggttctagacatcgtccctattggctgtgcatgggaggcttggtgaagcagagaaaggaaagtccagggaaggggcccaaaaagtcaaaactgttaatcacaaaacaaaagaaaaagtgaatttttatggaaaagaaggggatttttatttggaaatgcttaataatagtggttttcattctccagttatcacaaatagcattagaaatgaatgcgattgcaatttactccatcttcaccaaactttgtagaactacatgtcaacatatctctgacttctttcagtcagttgtcagtcaccattttgaaaaaaatacccacatgttcgatattttggtatcacaagcacttgagttcttagtgggattctcagctctccagtttggtctgccatttgctaattagacttctcttactgtgccataaaatgaagactttaacagcagaaaagcagttctcccaatgtttactttaagtttct

SEQ ID NO: 99681 - DNA, 1454 bp, Homo sapiens
ctcacctgtgcctcagaatgtctctgccacctgttcacaaggttggtaatttaacatttgctttactgctgtggtccatgtagtgacaactaagttactttgaaaggctctacaaagttccaagcagttggctgggcagtgttccaggtttccataggggcctcagcatggccggctttccctctcactttgattttagaaacaggcaggattgtgagaacgctctcaggagtttctcaagcctcattttgctcattcgtttcaaggccctatgtgtggcccacaggttcttattgggggtccctggatgggtttcctgaagccaccatgtatttaagtgtattttgggggacagtgcatctaaaactctcattaaattcaccaggaaggtatttaaaaggcccattttttatgaaagtggataaaaagtgaaaattatgccatggaaagttccttcatatttctatctttctctttttagaggaactaatgggaagtgactaggtaaaagggggtgaggcagacacacactgacagccttgttgtagttctgtgcggcttgacgtttctgtgtcttacgggtgggatgggaaacaaaatgataccgctggcatcactggaagaccatttgacttagtggaagcaaaggcggggaggtgcgtatgatgctacaatgtgtttctgtcttccactgagcaagaagaggaggttgagccattgggaggagcacagaggccccttggagcagttgctgcttctcagatttctgtgtctgatgggtactgaagataggtctggagctttggctgctgatgccaaaggcacctgttttaggagattgctctgcttgagaagtccatagtagcttacctaaatagtaaagttcatgactactgccttcaagataagggtctagagggtagctttgaagagtgagaccgtagatgctcacacactctttgacccagcaattctacttttaggggcttattttaagaaataatcaaggtcattattcatcccagagctctttatcatagtgaaaagttggaaatgtaatattaaaatataggggattggttaaacaaattatgtatatccacacaatggaatactaggtaactgttgagaatagtcataaagaaagttgttctgaaagcattgttatgtgcaaaaaggtatgtaatgcctttgtaaaaaaaaaaaaaaaaaaaaaactattgagaaggtactggttgggccctactatgggccaggtaccctgtggagtactggtgacacagtgatgaactagacagatatgtcctcaacaggtcttagtctaccaaggcaagagtcaggtcatactgactctgtcattaaaaaattctgtaaataatccatgggttctgcaaccacagattcaatcacatagattgaaaatatttggggaaaaagccaaaaaataacaatgc

SEQ ID NO: 99682 - DNA, 429 bp, Homo sapiens
acagaaagcgttggtggcccaacatatctcattttcatcattgtcagcctcctgcaactgcaagcttctgaacatgtcataaatccaatagaccaaatgtctccaggagctcagcaaagaggctacagcttttttgtttccacttaggccagggttatgggtagtaataaactcagcagtcaaggccagaaatgtgataatagtaggaaatgagaaaagggttagagaaagaaaagctaagtcggaaaaacgctcagctctccttgctttgctgagttttcaaattcattagcaacctcaattattcaattcctcaattttaatctctaattaaacattgccacagacactgtatccatggagagttgaatttaagtggcctctttttaataattgtgcaactatgatccctgcattgttaacccagag

SEQ ID NO: 99683 - DNA, 759 bp, Homo sapiens
cccgggagtctccagagcagcgcgcggggcagacctcctcgggtcctccggcgcttcggtctccggagacgcccggcctcctgaagggttcggcttgtcctcctctggcgctcagctccctctggcggccgggctggcaggacctcagcgcccagcccttccgtcttgttacgtccagggtctcactctgtgtctcaggctggagtacagtggtgcaattgtagatggctgcagccctcgacctcctgggctcaagtgatcctcctgccttagcctctcgagtagctgggagtacagatgcacaccaccacacccagcctagaatgaagaaacctgcagttgggaagcatgaatttaccacctattaaggcactggtttactgagacaattcaaaacacacattcattttgtgtgcttatgaaatatatcccaagatccccttttatttttcagaattgtggcttgcattgtaagaggagcctgtgaattcagaggcaagtctgctgaggaccgaatgttcctgtccataaaaacagaagtctggcctgggctcctctcttgggtgaatttgcaatgccagatcctctctatcagtctggtttgtttcttgtatctctgggaaggcaggcagacagcacggtcacctgtgaatgcagctacaattggcttagctgcctcactgataaatgtgcccccagtaagctacaaagggattaccagcgttctcagcagctaaaggaactggtgaagatttcccc

SEQ ID NO: 99684 - DNA, 249 bp, Homo sapiens
attgctgggaagatcaaggaagagaaaatgaataatatatgtaagagaactttgcacactacatagccctacacagaacgcattattaccaagtattttacatttataaagtgcttttcaaagcactctccacttaaaattcaattcacaatcaccagctaaggctgaagattcagacacaaaatccccgcctgcatgaagctcatgttctggactccagcctgggtgacagagcgagactccatctcc

SEQ ID NO: 99685 - DNA, 900 bp, Homo sapiens
gatatttatagtaagatatattttttaacatcatgacctatagacttgtatgtacgtttatgtgtacatacaagtaacatacttacccttacataacatgtataacatgtacatgtacatacaagtataacaatacttacccttacatatcatgcaaatatgttttttagtgtcattttttaaatgctggtttttatccactaaattgagttgatgatccacaaatggattactttctgttatttgaaaaaatgtcctaaaacaagcgctatggaacactaataatggcaaaaagatttaagaaatgtgtcctgtgtgccaggtaccgtcttaagtgtttgttttacatgcagcaactgatttaatccttatagcaactctgacaggaactattatccccttcttacagatgaggaaatttaaacattgaaagtaagaaactcactatgatacaactagacagacattggggaagctgggatgcaaacccagaattctggtccacagttcttgctctttaccactgtattacattgcctttcattggtgccactgacttctcaaaaagaaaagaatggtttcagagtcaaatgtgaagaatgttgtttcttaattattattatttatttttcacttgaaaatgtacaacgcccatgaacaccttaaggctttatagtgctataatgaagaagaagaaaaccatttacttgagcacacaagtctctttaattagctaaaattaattaattaagcatctataaagacaagttgggaaatgctcctggagagtcagtcaagaattctttgagtagcaggtaatacaaactcaacctgagccattctaagaacaagctggatattggcaagaacttacttagtaaactactaggagaatctctc

SEQ ID NO: 99686 - DNA, 889 bp, Homo sapiens
gattgagataggtctcaatcctttttgatttacacagattttcttctagattctcatgcttgactctaaaataaaacgttcattttcacgggtttatggtggcactaatttttgttaatttttttctatcaaaaacactctactgttggcagtttttccttacaatcatacacacacacagacacacacacacttcttggagtgtttctgacttctttgccccacccctaccattgcagttattcagttgatgatgccctttcaaatgagggccattttagaacagagggaatggtctgttgactttgttttaaatggtggcaccatgcatctcccttgggcctgctgggatgttaaatggtgagcccagcagggaggaggcccttgatggtgcccatagcttggtgcaatcaaggtgaagtggatggagagttcctgatgctgattaaaataagcactgaatgcacaacatgtggccatttgtaaactcatttctcatttcacacacgttactgtgctttgccttcctagctgcatttgttggcccagtatgtcctcatttactagatgctgaaacaaagtgatttagtgactgtcagacaaatactggcatagggatccgactccagtcatctgccttctgattccacactgttcttaccccatcaccgttctgccatccctgagatgtagcagggcagccttggccactctcttcttcctgtggattgtactaggtcacccctcatctttaaatgttgaggactcggccgggtgtagtggctcacatctgtaatcccagtacttggggaggccaaggcaggtggatcacttgaggtcaggagttcaagaccagcatggccaacatggagaaaccctgtctctacta

SEQ ID NO: 99687 - DNA, 159 bp, Homo sapiens
tgacacacacacaacaaaacaaacacaaaaccactgatctgtgattgctctccctttgtgtctactgccgtatacatatatacaactatatatacacaaatatatatatacacaaaactgtcatttacctgtatttgcaataaaagcataatgaattag

SEQ ID NO: 99688 - DNA, 547 bp, Homo sapiens
taaccaaaaaaatgttatgtttgatttgaatatgacagattcttagagtagacagctttaaaatgttgggggaggagaagaaggctatttgaaaactcaacttgttactgtcagctcactcatatgtaggtagtcactaatttaagaatagcttctattttaaaaatttgtagttttacaaatattttcccaaataatattttatatattgttaggtttctagactagtccacagaagctctgtaaaccctaatgtaaccaaaggataatatacaattaatgtaataactaattgtatttattttaatgtttctataagataatgtctgctgtgagttgggactccccatgtctaagccattggagacagggactccatccggatgaacagtagagaagggagttttggcatcattttcaacagaaaagtgtgctaccctgtcctgtccctgctggtccaccccacagtctgtgtcaggcaccccgacttccatgctgtcttaggattgatgaactgtcataaacttcgttgattgcaccattatta

SEQ ID NO: 99689 - DNA, 289 bp, Homo sapiens
ttcactttatgaaatgctgagctccctttcccaaaaccaggagcagaaggaagctgccactggtatttgatgccgtccacgtttccaccctggcactgggtcccagagccacctttcagattccgtccggcgtgagtggggcagaagagccagcgctgcctgtgaaggcgaagctactgctgcttcccagctgccactcgggtgcttttggaggccatcaaagaaatggtttcctccagtttccaacagttgaaactactgtttttttttttgtttttttttttgtttt

SEQ ID NO: 99690 - DNA, 463 bp, Homo sapiens
tttttttttttgagatggagttttgctcttgttgtccaggctagagtgcaatggcatgatctcggctcactgcaatctagcctaggtgacagagtaagactccatttcaaaaacaaaacaaaacaaaaaaacccttatatatattttatatcagctgcaaagttcaaaataaaatgcaagtacattttaaaggtataaaaatacattctcttcaaaaagaatattcatcaactttgataaacagataactttttttttttttttttgagatggagttttgctcttgttgtccaggctagagtgcaatggcatgatctcggctcattgcaacctccgcctcctgggttgaagtgattcccctgcctcagcttcccgagtagctgggattacaggcgcatgccatcacgcccggctaacttttgtatttttagtagagacggggtttcaccacattggccaggct

SEQ ID NO: 99691 - DNA, 444 bp, Homo sapiens
  misc_feature (20)..(20): n is a, c, g, or t
tctagaggatccttacaggnagagagaactgagaaatctttgccaccagcctcagcatccaggccacttctgacaaggccactggggttttgtttttttaaagccaggatgagctggacccttgccataattccttcagcccatggaaggagatgaccccagagaagctctagccactgtgggcgctgcctcaacaaagagccttctgtgaggtctgtcccttcacctccaggcccaactcctgacagaggccagtgtccctgcttcctgggcctggtgaggttcactgcacacgggtcagcaatggcataggaatgggaaagctatcgagaaacgagcctgggtcctcacagaatgtacaaatcctgtctcagtaagtggccagcaaaagattggaccaaagctagacatggtagcacatgtctgtggtcccagctacccagg

SEQ ID NO: 99692 - DNA, 734 bp, Homo sapiens
agcggggttccgcccgggctgttccaccagcggcacttcagggcgggatcggccagtctgtggaggcagcggcctctaagccccggagggtttactgcccaggtttgggttccaggaataagaaatccactgaataggcttaacttagaagacacaaaggcgcctcctggcggaagtggccacgctccgcccagcctgagggaaagctgctctgacagctgggcccagagctgcggggggcggggccgccgcgcggggtgaggactcgcctcagggcgctgattggctggtggcgcgctccggggcggggccttcgtatccaggctggcgtcggggctgccgcgggacatccggagcagacacccgcgggcgcgcctgcggccccgaggacccccggctccggagcttcgtcgagcgttttcctagcgttactttcccaaataattttcaggaatgaagttacggctaaagggctctttagagattacttttgggccgggcccggtggctcacgcctgtaatctcaacactttgggaggccgaggccggcgcatcacgaggtcaggagcttgagaccagcctggtatggccaacgtggtaaaacgtcgtctctactaaaaatacaaaaattggccgggcgtggtggcgggcgcctgtaatcccagctactccggaggctgaggaaggaggatcacctgaacccgggaggcggaggttgcagtgagccgagatgg

SEQ ID NO: 99693 - DNA, 399 bp, Homo sapiens
aataccatttgatatcaagtagacttgatgtaaagttgtttcagaacaaagaatcatccttactgggtttctgtaataatttgtttttggtttcattaaagttttggggttttggtttttgttttttcctttgcaacaaggtctcactgttgcccagactggagtgcagcggcatgtgatcagggctgactgcagcctcaacctgccgggctcaagcgatcatcccacctcagcctcccgagtagctgggactacaggtgcatgccaccatgcccggttaatttttgtatttttagtagagatggggttgtaccatgttgcccagactggtcttgaacacctgggctcaaaagtgaactgctcacctcagcctcccaaagtgctaggattacaggcctg

SEQ ID NO: 99694 - DNA, 239 bp, Homo sapiens
aagaacatcaggaaattttcttttccaaagttacttctgaaagtaaattggctgggtgtggtggctcacatctataatcccagcactttgggacgccaaggcaggaggatcctttgagctcaggagttcaagaccagcatgggccacacagtaagacctcatccctacaaaaaatcaaaaaattagctaggtatggtggcacgcacctatagtcctagctactcaggaggctggggcag

SEQ ID NO: 99695 - DNA, 150 bp, Homo sapiens
ggagtaaagactgaatagtcctgtcctaggtcattaaagagagtggtgaaagcactcttgctacagtagttttgtcatttattgtatagtgtaagtctaaagtttgttttattatttggcagttctttttttatcttgttataaaatcat

SEQ ID NO: 99696 - DNA, 524 bp, Homo sapiens
agatactgatggtggcactgcaaactggctcaggctttctggtgaacaatctggtataattgcctaataagaacaatacgacttttcaccttgggtccagtgatttagctaaagcaacatacttgaagaaaataatttcaagctgggcacagtggctcacacctgtaatcccagcactttgggaggccaaggcagaaggatcgcttgaacctaggagtttgagagcagcctgagcaacatggcaaagccctgtctctacaaaaaaatacaaaaattagctgggtgtggtggtgcatgcctgcagtcccagttacttgggagggtgaggtgaaaggattgcttgtgcccgggaggttgagggtgcagtgaaccgtgactgcggcactgcacatcccatcctgggcaacagagtgagacactgtctcaaaaataagaaaaagaaaaagaaaacaaataaaaacaaatttctggctgggtgaagtggctcattcctataaacctagcactttgggagaccaaagtgg

SEQ ID NO: 99697 - DNA, 421 bp, Homo sapiens
tgtgtcctatctggattctacaaccctgggccggacacagtgagtcacacctgtaatcccagcactttgtgggggccaagatgggaggatcacttgaggagaaggagtttgagattttacatcccaaacatatttcaattctagtgatggctctctgcccactctgccctcattctatcccaggcaatcagtattacttgcccagactactataagagcttcctaattggtcttgatatttcctctgttttgctctctcccccaacatattgttctcaaagagacagagtgagattgtaaaaatataaatcaatcagactatgcctctgatttaaactattaaaagcctacccatttcagttggaataaaatccaaactcttcactgtgggcttattaagccaatttgtcctctttgtatc

SEQ ID NO: 99698 - DNA, 679 bp, Homo sapiens
ttcacagttcttttcttttagcacttcaaacatcaagttccactgtgctttggcctccgtttttctccatgagaaatctacaggcatttgaatcgatgttcctctatatgtaatgagttgtgtttctctggctgctttcaagattttttccttcatctttgcttctagtagtttgattatgatgtatctttatgtaggtatctttgacttcatcctgttttaagtttgcttttttaattagtaaattactttcagcaaatttgggaagcttttgtccatttttttcttcacatatttttctgcctcaatcttttctggtattctaataatgacatgcatgttagaccttttcatatataaatatagagaaatagtgtgtatgcatgggtgcgtgtgcacacaccccctcccccatctgcttagaatttctgtctaccctaggatgcttgtagagtatttttaaaaaaagaaaaaaagaacttctgtttttctattcacttcaagactgttcaactttatctcatggagcgtggatataatggctgttttaaaattccaatatgtttttcatactgcaattagcatttgttggttgttctttctcttgactattggccatatttccctgttactttgtatgttgagttaagtttggcttgtatcctggacattttgaata

SEQ ID NO: 99699 - DNA, 363 bp, Homo sapiens
aagattgcaccactgcactccagcctgggcaacacagtgagaccctgtctcagaaaaaaaaaagaaaacaaaaaaccccacaattttctatttccttaaaattgagggaaagtcacgtaaaaactagaagtataaattcttatgggtgggcaaatctgcgtaagagggtttgtttttgaagcatggcagatcagagaagacagttgctcttggaaagttctgtcagcatcacacgcatgcctttcctttccgagtttatctagatgcgctgcttctcagtagccggtcgctttgtccacgacggtcctgacacacaatgtgacatagcttcacacaacggccactttgaccctccctccctac

SEQ ID NO: 99700 - DNA, 808 bp, Homo sapiens
agtccaggctgaggtggtctcagatggagataagccacttcttaggaaccggagtaaaggtaactcttgctatgcaaagagactcacagcattttgtccctcccctagagatctgtggaactttgaacttgagagaaatgattcagggtatctggcagaagaaacttctaaacgacaaagcattcaagaggaagcagagcataaaagtttggaaaatttgcaggagatcatttcggaattttaaggtttaatgactggcctattggatgtgatagaaaagaaaaccccattttctggggagaaattcaagcccaatgcagaaatttgcacaagtaatgaggaatgttaatcaccaagataatgtggaaaatgtctgcagggcatgtcagagaacttcaaggcagcccctcccatcacaggcccaaggcctaggagggaaaaatggttccatgggcctgggccaggcacagggaccctctgctctgtgcagccttgggacatggtaccctgcatcccagctgcttcagctgcagcagtggctaaaaggggccaaggtacagcttgggccattgcttcagagggtgcaagccctactcactggtggcttccacatagtgttgagcctgtgggtgcacagaagtcaagaactgaggtatagaaacctctacttagattttagagcatgtatggaaacagctggatgtccaggaagaagtttgctgcaggggtggagccctcatggagaacacctgcttgggcagtatagaagggaaatgtggggtcggggcccccacacagagtctccacg

SEQ ID NO: 99701 - DNA, 678 bp, Homo sapiens
  misc_feature (388)..(388): n is a, c, g, or t
tcagaagctggttcaaaaggctccaaaatgcgttggaagcttcgtcttttaaaagggaatcccctgtaaatccccaggctcacttttgaaatttactaccagtggctttccctgaggcaaaattgtgcttgtctacaaccacggccgtttttaattttttaaaagccacctcctttttttctcctcaaactggggtgtattcattcacgctccaatcttagtgaatctttgtgtatcactaggctcccaggcccgcattctggttccgggctacttggcagcaccattttcaagggatagccaaagcacttaacttgttggtgggtttcacattgcttagtcctggtcaaatcgtcaaaagatccaagttcctcgtaatcatctttanagactgccccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagca

SEQ ID NO: 99702 - DNA, 678 bp, Homo sapiens
ttactaaaattttggtctggaagcctcgatatggatacaggtcctatttgtttaaaaggagacccgtgtaaaccccccaggctaggaagaaattaactcccaggtgttttccccagtgcaaggttgcttatctcatacccgggcgtttataatttttagaggcaccgtcttggtgtcctcaacaatagggtgtaatcaattcgccttcccatctagagaattttgtgtaaatcacaaggcgcccttacccgtttaactgtctgaggggcacgttgcaagagcatctttcctgcgatatgggaagcccttaaccttgagatagagcttcacaatgcttacagccggaggaactatccatatgaaacaaatttcttgtgattatctttaaaggctatcccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagca

SEQ ID NO: 99703 - DNA, 231 bp, Homo sapiens
  misc_feature (2)..(2): n is a, c, g, or t
  misc_feature (13)..(13): n is a, c, g, or t
  misc_feature (34)..(35): n is a, c, g, or t
  misc_feature (75)..(75): n is a, c, g, or t
  misc_feature (79)..(79): n is a, c, g, or t
ancaccataacantttattttccaaacgtatttnnccttaaaaaaaaaaatccacgcaaatagttgtctctaagncttnttcccaatagcttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagca

SEQ ID NO: 99704 - DNA, 331 bp, Homo sapiens
tcaaaaccgtatcagaacagatgggcactctggttttttaaaagttatttcagtgtgttaaatgatttttggtttgtctgtggtttcatgatgaagctgaaccaaaatcatttgcaaatggttcatgcacacaagttttgttgtcaaatctattgaaaactggtctatcattaatattgttcaccatctgctttgtttgtttttaatgtttataatatgataatgtatatgttctgaaattagttgtttttataataaaaggaaggatattacccctttgatatctcatcaaaagcagccattcctctcattaattctgttacagttttaa

SEQ ID NO: 99705 - DNA, 1934 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagca

SEQ ID NO: 99706 - DNA, 3602 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99707 - DNA, 3546 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaactattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99708 - DNA, 3842 bp, Homo sapiens
  misc_feature (3670)..(3670): n is a, c, g, or t
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataaaaaaaaaagaaaaaaaaaacaaaaaaaaaaaaaacacaaaaaaacaaaaaaacaaaaagacaaaaaanaaaacacaaaagaaaaaacacgcaaaacgaggcacacaacccgacagaaaaaaaaaagaagcggtggggcgcggcgccgccgccgcgcgagacaagcctctccacacacacggtggggggggggggcccccaggcgaggagcgacgggcgggcgcacaggcgctcaaaggga

SEQ ID NO: 99709 - DNA, 2803 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcagagtgtgcgtgttgaagcaacagaaataggagctctggatggattcatgatccttaacagttatggtatttgatacagggggggttcaaagtattgataagaggaggtgaggttgaaattttccttgacaatcaacagggggtgtgcaaagtttcaaaaatatatggtgaattattaaggaacatgttgttggtgttgtttttttctaatt

SEQ ID NO: 99710 - DNA, 3540 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99711 - DNA, 1914 bp, Homo sapiens
tcatcgctgttccagacagcgatgactcgagagcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagca

SEQ ID NO: 99712 - DNA, 2174 bp, Homo sapiens
  misc_feature (2002)..(2002): n is a, c, g, or t
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaaaaaaaaagaaaaaaaaaacaaaaaaaaaaaaaacacaaaaaaacaaaaaaacaaaaagacaaaaaanaaaacacaaaagaaaaaacacgcaaaacgaggcacacaacccgacagaaaaaaaaaagaagcggtggggcgcggcgccgccgccgcgcgagacaagcctctccacacacacggtggggggggggggcccccaggcgaggagcgacgggcgggcgcacaggcgctcaaaggga

SEQ ID NO: 99713 - DNA, 3496 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99714 - DNA, 3473 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttagtgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99715 - DNA, 1268 bp, Homo sapiens
  misc_feature (1096)..(1096): n is a, c, g, or t
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagataaaaaaaagaaaaaaaaaacaaaaaaaaaaaaaacacaaaaaaacaaaaaaacaaaaagacaaaaaanaaaacacaaaagaaaaaacacgcaaaacgaggcacacaacccgacagaaaaaaaaaagaagcggtggggcgcggcgccgccgccgcgcgagacaagcctctccacacacacggtggggggggggggcccccaggcgaggagcgacgggcgggcgcacaggcgctcaaaggga

SEQ ID NO: 99716 - DNA, 3546 bp, Homo sapiens
agcgggtagtccccgcctcttccccaggggccgcgtcggagcctccgcggcggcggcggtgcttacagcctgagaagagcgtctcgcccgggagcggcggcggccatcgagacccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99717 - DNA, 3678 bp, Homo sapiens
tatttttagtagagattgggttttgccatgttggccaggatggcaaaatttaatttttaatggccgtttagtagtcctttgtgtgatgtactataatttatttgtctcctatgattggaatttaggttgtttctaatttttgctgacacaacacttatatgtacccattttgcctctttgaatatttccatagaataacttcctgggattagaatacttttcttaaaggatttgtgcatttcaaggctttcaaaatacgttgccaaatagctttcgagaaaggctatttatttcagtttttgggttcttatctttctaattggctttatgcttacattaaaatatgaaatttttatttagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99718 - DNA, 3471 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcaggatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99719 - DNA, 3230 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgtgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99720 - DNA, 2572 bp, Homo sapiens
atcaagtctgtgatgtattaataatgccttatatattgttgtaagagctttttcaaacattaaccacattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99721 - DNA, 2527 bp, Homo sapiens
ggcggtacggccggactacgggattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99722 - DNA, 2298 bp, Homo sapiens
agcggccgcccgggcaggtacgcgggatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99723 - DNA, 1897 bp, Homo sapiens
ttgctacacaagagatatttattaatgttctgttgtatttacagttttaacatagcaaaccgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99724 - DNA, 396 bp, Homo sapiens
ggaaagagagactcctgacttcaggagtttttagaaaaagcattccagttttttctagttctagaggccttgataactttaagaactgaaattttaatgtttattgaataccgtgatgtcagtatacagtaatcttaaaactatgttaaaatgcacttgtgtctccaaacatcctgccttcttttgtgactacatccttctcttagccaaaataacaagctaactagagtttcaatattcaatatccttctctggcagatgttttctggcaaaggccttcctgcatttatgaattctctctcaagaagcaagagaacacctgcaggaagtgaatcaagatgcagaacacagaggaataatcacctgctttaaaaaaataaagtactgttgaaaaga

SEQ ID NO: 99725 - DNA, 467 bp, Homo sapiens
ttttgcagtggcattcctctttaactggattgggtttttcctgtctttttgcctgaccacttcagctgcaggaaggtatggggccatttcaggatttggtctctctctaattaaatggatcctgattgtcagggtaagttgtataacagaaaagatgggctctacagagaggcaataatcagaatatttttgaatattcgatttttcatttgcttttttaaaagttatttcagtgtgttaaatgatttttggtttgtctgtggtttcatgatgaagctgaaccaaaatcatttgcaaatggttcatgcacacaagttttgttgtcaaatctattgaaaactggtctatcattaatattgttcaccatctgctttgtttgtttttaatgtttataatatgataatgtatatgttctgaaattagttgtttttataataaaaggaaggatattacccctttgatatctc

SEQ ID NO: 99726 - DNA, 394 bp, Homo sapiens
caggctgtcttttatcctttggaaagtcatttaaacagaggcaggtgtaaggcactcttgttcttgggtaacaggacatgtctaacatctttcccctcctctgcttttgcagtggcattcctctttaactggattgggtttttcctgtctttttgcctgaccacttcagctgcaggaaggtatggggccatttcaggatttggtctctctctaattaaatggatcctgattgtcagggtaagttgtataacagaaaagatgggctctacagagaggcaataatcagaatatttttgaatattcgatttttcatttgcttttttaaaagttatttcagtgtgttaaatgatttttggtttgtctgtggtttcatgatgaagctgaaccaaaatca

SEQ ID NO: 99727 - DNA, 3548 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacagggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99728 - DNA, 2124 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcacaaaaaaaaaaacttcaggacacaacacattagtggggcggcgcggccaagaaaaagtccagaaacaccgggggggggggccccgagaaaggggaagtgggccatgcccgagaaacggcacgaagggtgggtccccaaaaacccggggacgcgctgaacccaaggggggggtgggccagggccgggatac

SEQ ID NO: 99729 - DNA, 3583 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99730 - DNA, 3540 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattgctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99731 - DNA, 986 bp, Homo sapiens
  misc_feature (892)..(892): n is a, c, g, or t
  misc_feature (909)..(909): n is a, c, g, or t
  misc_feature (913)..(913): n is a, c, g, or t
  misc_feature (916)..(917): n is a, c, g, or t
  misc_feature (922)..(922): n is a, c, g, or t
  misc_feature (937)..(937): n is a, c, g, or t
  misc_feature (945)..(945): n is a, c, g, or t
  misc_feature (947)..(947): n is a, c, g, or t
  misc_feature (952)..(952): n is a, c, g, or t
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagcgntggttctggaaggcctnctgnttnntgaantccttcagaagcaangaactgcngnaggantagatgcgaccagggagataccggtttaacttag

SEQ ID NO: 99732 - DNA, 3389 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagattttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcagtgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 99733 - DNA, 554 bp, Homo sapiens
agcgggtagtccccgcctcttccccaggggccgcgtcggagcctccgcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagaatgacgattttgggggtcggcatgaatttgcatcagctccacatcttagga

SEQ ID NO: 99734 - DNA, 691 bp, Homo sapiens
agtacaaaaattagccaggcatggtggtgtgcgtgcacgcctgtaatcccaactactcaagaactggaggcaggagaatggcttgaacctggaaggcggaggttgtagtgagctgagatcacgccactgcactccagcctgggtgacagagactccgtcctggtgctccagcctcggtgacagagactccatctcaaaaaaaaggaaaaaaaaaagaaaagccatctggggacaactggtaacatttacagaccaggtggcctgatgtttgcactgatgacaacccagtctccttcagcctggcctgccctctgcactccggatctaagtgtctgggcctgctggacaaccctacttggctgtaacacagactcctcccgttggtccacagacaaaactcagcctgcttgcttctcctggttctcttttgctattttaagtctcccttgactcctcactcccttttgcagccagaccagcacacaagtgtctttttgctccatcgacggctgtctgtcctcactggctcccacccactgcccggctcagtctctcaccaggatgaccacgacagcccccgacctactgtctttctgcttctcccatccattcgccatggcaatcagagggattttttgcaaataataaaaacctggcctcgttggcctcagcggtggagctctgcagaccg

SEQ ID NO: 99735 - DNA, 472 bp, Homo sapiens
agtacaaaaattagccaggcatggtggtgtgcgtgcacgcctgtaatcccaactactcaagaactggaggcaggagaatggcttgaacctggaaggcggaggttgtagtgagctgagatcacgccactgcactccagcctgggtgacagagactccgtcctggtgctccagcctcggtgacagagactccatctcaaaaaaaaggaaaaaaaaaagaaaagccatctggggacaactggtaacatttacagccagaccagcacacaagtgtctttttgctccatcgacggctgtctgtcctcactggctcccacccactgcccggctcagtctctcaccaggatgaccacgacagcccccgacctactgtctttctgcttctcccatccattcgccatggcaatcagagggattttttgcaaataataaaaacctggcctcgttggcctcagcggtggagctctgcagaccg

SEQ ID NO: 99736 - DNA, 145 bp, Homo sapiens
gggctttgaaaaggccgtgcagaggagactcttgagctagattttggcattatcgacagtggggcacagcataggtaggcaagtaattcaagatgttctaggcccagcagggtggctcatgcctgtaatgggatgagctggggca

SEQ ID NO: 99737 - DNA, 414 bp, Homo sapiens
tttgatgcagaaattttttaaattttcaagaagttcaatttgtctttttcttttgttgcctgtgcctttggtatcaaatccaagaaatcaataccaaatccaatgtcataggttttgcctatgttttcttctaagaattttatagtttcaggccttacatttaggtctttgatccattttcagttaatttttgcacacggtataagataagggcccaaattcattattttccatgtggacataccgtttacctggtaccacttgttgggaagtctgaatgaatggtgtgggcatgtgggcaccctcgtcaaaaaccatttgatgaggccaggcgtggtggctcacgcctgtaatcccagcactttgggaggccgaggcaggagaattgtttgaacccacatggcggagactgcg

SEQ ID NO: 99738 - DNA, 251 bp, Homo sapiens
  misc_feature (19)..(19): n is a, c, g, or t
tctagaggatctgggaatnctcctcctcctcacatggctctggtttgcaaaatgtgtaccattgtcttgaccatttagagtgtggttagaaggaaccctgaactgtaagaaaagtagaggctttgtgtgtgtgtgtgtgtgtgtgtgtgtgtgtgtgtgtgtgtgtgatgtccacttaataataaatctgtcatcactgactggtgttcatttcctctgaaataaacaaatcactattaagtcctttgaaa

SEQ ID NO: 99739 - DNA, 263 bp, Homo sapiens
atgggtaatgacatgtgcccacccttctggcatcacacgggggcagttcactgccctgaacaccctgtgctctgcctgtcacttcgtagtgcccccagaagccactggtctcactctctctagcttcaccccagcagcctctagtctcccgctctctctagctgcacctttcccggagtgtcgtcgtcacattggaatcatcctgggcttagttttgtagattggcctcttcacttacagttctagaagttttcacaaatttg

SEQ ID NO: 99740 - DNA, 161 bp, Homo sapiens
gagcttggacaggccacagggcatgggctctgagcttcagcctgggcatctgaaagttcctggtcaccgtgggggtctccatggtcacccaggccatgttcgcctgagaagagggtgctaccaagaagcgccggggctgggctcctctcaaggggctcacg

SEQ ID NO: 99741 - DNA, 301 bp, Homo sapiens
tgggttcatgccattctcctgcctcagcctcccaagtagctgggacttccagcgtctgccaccacacccagctaattttttgtatttttagtagagacggggtttcaccatgttagccaggatggtctcgatctcctgacctcgtgatccgcccgcctcggcctcccaaaatgctggaattacaggcatgagccaccacgcccggcctctcctaaggtttctatgtgtctatcaacttttctgctctgcaggcatttcctgaagacctacagtgtgttgagccctacgcatttctctctct

SEQ ID NO: 99742 - DNA, 177 bp, Homo sapiens
tctgggaggtgctggctttcacccctccccagggagccctcatctaggtcaccggggcctcctgaccttggcctggagcagcacttcagtggctcacattccacctgcacagggattgggcccaggagtcctcactttcatcctggtgtctccttagttcctggaggagggtgggaa

SEQ ID NO: 99743 - DNA, 440 bp, Homo sapiens
ttccttccaaattcacaattttttagaaaatggttttgttttaacaaagaatttttgttctcccccggcattttctttcttcgaattagaaaaccattcaggcaagcaccggctttcaaacggtgtttttttctcccagttggcgctaaaatgcactcatttctcctcaaaaagattctataatagataaagggcggcccattttttttaaactggtcgcattggggataagcgggcctcattcttttgtgactggacccattctctttcgaaggcagagcaagtatatcccttggggctctcaacccataccctgagggtcctatcaaaatatcctttccattcacttacaatagaacgaattccaagggaagttgttacaaacacaatttcccagtgacaccagcttcccaatgatgtttttgggtccgcacgtgccc

SEQ ID NO: 99744 - DNA, 275 bp, Homo sapiens
tgattaactggacccattctcgattaactggacccattctcgattaactggacccattctcgattaactggacccattctcgattaactggacccattctctttcgaaggcagagcaagtatatcccttggggctctcaacccataccctgagggtcctatcaaaatatcctttccattcacttacaatagaacgaattccaagggaagttgttacaaacacaatttcccagtgacaccagcttcccaatgatgtttttgggtccgcacgtgccc

SEQ ID NO: 99745 - DNA, 648 bp, Homo sapiens
aggctgaggggcgcctggggttcgcctccgtgggcgcttcttccggtcagccaccggggcttacccgccatagcgcagatgcaggctcctgagctgggcctttcttttgagtgactcgtgtgaagatttagactttcgaaacttattaggaataagaccttatttacaaaaacaactcctcacccggtcggtagtttccgatttgaattttctaatattgtttgaaaatatttatcttatttacttttttggacgactccttaaattttgtgactcaggagattggtcctagcaccgtagtctttttttttttttttttttttgggaaagggagttccggcctttggtcgcgcccgggggggagtccaaggggggggatctcaagcctcaaggggacccccaatttcccaaccctcccagggtgccaagggattcctccgggccttaagccctcccggagtacggggggacccacgggggggcaccaaccattgccggggtataatttggggacttttaaattaagacgtgtgggggtctcactatattgttggggccagggcggggctttgagaacttccggggacctctcggggtgactccgccacctttggcccccccaatttgtggggattcacgggcattgat

SEQ ID NO: 99746 - DNA, 1042 bp, Homo sapiens
cccccatggacttagggcccccacaaagagaaaccatgtgccttctccccacttcccttctggcttgggcaaatgaggctccctttaggggtagaggtactctacaggggctatgttccctttaggggtagaggtagtctacaggggccagctgggcagagatgaaatcttgcaaaggaacccttcttacactcgaaaagcaagaatagcaaagggactttgggaaggacataaaacaagaaaaggaagctcctcaccaacagctcccagatggagggagtttgtgtgtctagcattttcaccaaagtgctgctcatcctgatgcacagatgcagattggagctgctgcctgtgccctcaccatgggtatgtacccaccacaggcattcccaggtgatgcgggggcagaggattccctctttccactcaggataacaacccctcgatggggttttcaacaagtatagaaagctcctggactcagccaagaccctcacctacagtcccagtcctcccaccttcttcaggtctctagaagacagaactgatgggtttacaacatcctattatccagcactagtcctaggttgtggatgtagggaaaggccaggtaaacaaggaagggagaacaggtgaatgaccccaattgtttgaaaccaaaagagcagaattgcccctaattgatttaagtaaacagcaagtaacataggtctgttaaatagaagaggatgtgagcaccagatgcacgtgataaagaccatgctctggaagattcattccaaggagtagaagtggtatttactcagggcatttaaggagagcagggactctgaaatgaggtgagagaaaagataagacatgcaggaacagctggcaacaccaagaaagaatttaaggagagggatctctctgttagagaacttaacattaccctaggaacagcaagagcatcatcagccccaggaaaatctacctctgatatggagaccaggcttaagaaaatcccctagaacccagagaaaaagtgcaaaacaaggaaaat

SEQ ID NO: 99747 - DNA, 700 bp, Homo sapiens
atcatatcattattttaagtgataaatgatcatctacattcagctctgatgagtaataggtgttcaaaaataggaacttccagccaagtgtggtggctcatgcttgtaattccaacacttttggaggctgaggcaggagggtcgcttgagcccaggagttcaagaccagcctgggcagcaaagtgaaacctcatctctactaaaaattttaaaacattagccaagtgtggtggtacatgcctgtggtcgcagttattcaggacgctgagactgaacgatcacatgaggccagccaaggattcgaggtgtcagtgagccacgaatgtaccactgcactccatcctaggcacagagcaagagcaagaccctgtctcaatcaatcagtcaatcagtcaaaactatgaatttcccagctgtatatgaaggcacctcaaaacaccacagtgaactcacagagggacacggaatagtttagattttaattttttgagggaaatgcgatgacatctgtcacacaccgcacaaacggctactattaaactgaacttactgattagtggctactaattaatagttggtcattaagcagtaattagtgattaattatcaagtaattaggacttaattaaaggaactgtcacagtttcctttagtcctagggcagccatgaaaaaaaaaatgctgactctccaaagacacc

SEQ ID NO: 99748 - DNA, 322 bp, Homo sapiens
agactttgcttctcctttattcagtgagggattggactagctggtccttaaggacttttcagaaagtctggttctgggagatgaccaatgggatcatcttatgctatgagctttcctggaatgacaggtaattggtgcgccttcccagcagggtcagggagagtcgctgggacttgaagggaaggcttttggggagaggagccagtgttacaaactatcgaaaagcttggaggtgggaaatttgcgaaaggtgattccagggtcagcttttttgtcacctgcttccgacttcggcagtttggagagggcgagtaataccctt

SEQ ID NO: 99749 - DNA, 225 bp, Homo sapiens
caacatattatatggttatggtttgtgtgcatgtgtgtgtgtccgtgtgcatgtcattgtctcattaaaatctcctctatcaagaataactttttgtctacttgacctatccgtttaagatggaagtgtgttaaaatctcccactctgattttaattcaatttcatatctccagtcttgccctcttacctgaactccagactcttgtatccttcttgtaccctct

SEQ ID NO: 99750 - DNA, 657 bp, Homo sapiens
agcctctatttgacttcaactacaagagagatgccaagctgagaccagttaagccacagaactctttcagaaaagtcatatttttctcaaatgacctagcttttaccttcgttaactcaaacctgcacccatctgaagtgaaaccagcaaccacttaacagcaaacagtagcagcagcatgcaccaaaagagaatggaaagtgaaaagaacacaacagatcattttaaaagtagtgtgtcaattgcctggttctccactgacagctaaaattaaacaaaaaagtgaattccgttctacagtgtgaccatcttatgggaacactagaggatatccatagacagcagagaaaaaatagcaaaatagatattttgactcacagaaaatgaatgtttgcaaagattcaccaagaaataaagtcaaccaaaaaagcaaagtcatggaaaagaaatgcaaatctccacaaaaggcagcttttcagggctattcctgtctacacgccctctgaataaccatctcaaaatatgttcaagaagtatattttggaggtggcattgcagatgggatctcaaagccaagtctctacatatgatacaggcaaacagatgtttacatgacttgctcctccttgccttctgccatgattgtgaggcctctcc

SEQ ID NO: 99751 - DNA, 404 bp, Homo sapiens
gctggatacctgtcaagatgtattcatgtaaactatagcccttgagtgataattatgtatcaacataggtttatcagttgtaacaaatgtaccactgttgccatggattgaatgtttatatcccttcaaattagtgcgttgaaatcctttttgcttttttttttagtttctttttttctaagttcatgtcagataggtaatatgcccacatggtagctgacagagcagaagcatcaccatcttggacaagcactgccattctaaagttccccttgatcaaaaattgcctaaatccaaaggtcatcagcctaatgactaaggtcagcatgaccataagccacaaatgacatctccgaccagaaacatttcaaccataagataaatccctccctgaccagagacaa

SEQ ID NO: 99752 - DNA, 174 bp, Homo sapiens
ctgtagattcgaatcgagctcggtacctatatcacagaatgactgaggataggaatgagaatataaaaaaaggagatgaaatgagaggaaataatctcagagcctactgaacctaacactataggacaggtagatttagtataatttggcaagtatctgctattgaccaagaaa

SEQ ID NO: 99753 - DNA, 603 bp, Homo sapiens
aaaatatgactactaattgctttgttcagatataattttggttcgttgggactggaaatggcaaatgtataccatggtttgtaggttttttgtttttgtttttaatgctgttcatggagttgcactaattcatttatttaaacaagtactgaacacttagtcttaaaaacactattctcagctctggggtggaatagaaagattaattatgctttaggaataactattcttgatctcttggtaaattaaaacttgctgtgaaaggatcatctttgtaattgttaatgagcattcttcaagcagattgaatatccacagtttcttagtttaatttcatcattttgtgaaccaaaggcattttttctaagtaaaataaatggttgagtaaaaaaaatcgcccaacaaattttgtataatctaaattgctgttttttttaaaaaaatggatactgtcctttcaccatcccatctcctttccccagctgctgctgctgctttctgctttcctcctctttctttattcctttcagctttgggcggctgtacatgcaaagttttgttttttatcttgacacttcccattcttgcttccattccctgtaa

SEQ ID NO: 99754 - DNA, 865 bp, Homo sapiens
ctcccgggttcccaccctgtgcacacatctccactgcagagccaagcacttcttcctctcacctggactccaccatagcccatgttgcttcattggcctccaatactctgtacacatgacagccagaatgatccttcaagaaattcagcctggttgtgcaccccctttttagaaatgcaaatggcttcccattgctctaagggtgaagaccaacacttcaacctgatcctcccagcccacctggcccacctggcctgcattgtctggcaccctctgcacctcacctcaccgtcattccttattctctttcctcaagcctcattctccttcttcagctgtcaacaccatgttgtcctccctcccccaggcttctctgggcttttcctcttcctggaacagtggtcctccacatctccctactttactccaaatctgcttgcccctctgccatgtaggccaagggaatcacagccatccttgcacaggtcttagactctctggggacatcttcctggtgcttatcaagttgaaactttgcattcattagtaaaattaaatcaccacttgctttcacactgcatggtaatctctcttgtgtccccagtgtccagccattggcaggcacataacatgtgctcaggaaattttatttgaataaatgagtgaatgattcaatgaatggagcaagcctgagatagcctcatttcctttcccattggaggattgttctttcttctgtgaggacagaacctataccttgctgaaatattctggacagtgagaacccttctgctgagattgtcctttagctcctcacttggtgggatctcagagaagaactcttggagacagtttgaggacacca

SEQ ID NO: 99755 - DNA, 665 bp, Homo sapiens
ggtggtggcaccgcagacggcggcggcagcgttttaggcagatgcgcgctgcaggcaactccagcgctgttaaaccaacatcctcccttttcagaaatctacaccaacacctatgcagccgggggcacggtggaaggaggtgtatcgggagtggagctcaacacaggtatggggacagccgttggcctcatggccgcaggggccgcaggagcctcaggggccgcaaggaagaggagctctaccatgggaaccctgcgggactacgctgacgcagacatcaacatggctttcttggacagctacttctcggagaaagcgtatgcttatgcagatgaagatgaaggtcgaccagccaatgactgcttgctcatttatgaccacgagggagtcgggtctcccgtaggctctattggttgttgcagttggattgtggatgacttagatgaaagctgcatggaaactttagatccaaaatttaggactcttgctgagatctgcttaaacacagaaattgaaccatttccttcacaccaggcttgtataccaatcagtactgacctccctttgctcggacctaattactttgttaatgaatcttcaggattgactccctcagaagttgaattccaagaagaaatggcagcatctgaacccgtggtccatgg

SEQ ID NO: 99756 - DNA, 174 bp, Homo sapiens
caccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttc

SEQ ID NO: 99757 - DNA, 2127 bp, Homo sapiens
atgttcaggattctaaaaagagcaatggttcacaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaa

SEQ ID NO: 99758 - DNA, 649 bp, Homo sapiens
tccccttcccgccaccgcctccttctccgctggctgtggcgggcgaggacacgtcaggggccataaataaataaataattccattcacccgttgacagcgaggcgaatcggctgcggtttgctgggaacggagggctgcagcgcccaccctgcgccagagaccagataaagagtcaatcttaagatgtgatactttcctgtgaaacctgaaacaaggtgatctggggaaccaaagactctgggactcttggtgccaacagagttactctgttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggttggtatcatatgcaatagctgtatattccatcagttgattgacgtgttattatgggatcgctgtctaaagaacacaattggaaagataataaatttgttccagtttggaatcttcctaagttattgttaat

SEQ ID NO: 99759 - DNA, 2264 bp, Homo sapiens
tccccttcccgccaccgcctccttctccgctggctgtggcgggcgaggacacgtcaggggccataaataaataaataattccattcacccgttgacagcgaggcgaatcggctgcggtttgctgggaacggagggctgcagcgcccaccctgcgccagagaccagataaagagtcaatcttaagatgtgatactttcctgtgaaacctgaaacaaggtgatctggggaaccaaagactctgggactcttggtgccaacagagttactctgttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaa

SEQ ID NO: 99760 - DNA, 2108 bp, Homo sapiens
tctggagatatgtatgtaagtttgcttgtggctaaaagttaatgatcagttgcctctcttcttagccctgagcctggagaaaagtgtcaaacgcaggttctctctctattcaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaa

SEQ ID NO: 99761 - DNA, 2244 bp, Homo sapiens
tccccttcccgccaccgcctccttctccgctggctgtggcgggcgaggacacgtcaggggccataaataaataaataattccattcacccgttgacagcgaggcgaatcggctgcggtttgctgggaacggagggctgcagcgcccaccctgcgccagagaccagataaagagtcaatcttaagatgtgatactttcctgtgaaacctgaaacaaggtgatctggggaaccaaagactctgggactcttggtgccaacagagttactctaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaa

SEQ ID NO: 99762 - DNA, 422 bp, Homo sapiens
agtttgttgatacgttaattacactcattgacttctgaattttagaacaatcctccatttctacaataaatgcacttggtcatgatatattaccttttagaacatattgttggattctacatgctagaattttatttagaatttttgggctgggcgtgatggctcacacctctaatcccagcactttgggttggcttaagtccaggagtctaagactagcctaggcaacatgacaaaaccctgtctctgcagaaaataaattttaaaaaaagtcagctgggtttggtggtctgcacctgtaggtcccagctacttgggaggcttgggaggctgaggtgggaggatcacttgacttcaggagttggaggttgcagtgagccaagatggcaccactgaactgcagcctgggtgatagaacaaga

SEQ ID NO: 99763 - DNA, 543 bp, Homo sapiens
gacaattctagcctaattgtcttacatgtagagtgactaaaactgttcgaagacctttaaagtctttttgacctaacaaccaaagacagagttcagtatagccacagtcactggaaagggagggagagaagtccccaaaaggagagagccagagaagagtgagcaccaaatactgtgaataaattctgtacaaatctgtctaaggcttaaccacgtatgcataagacagactcagagcagttcagctaagaaggataaatgaactaaatggagatttgagctaccacgcaagagacagaatttgacctttaaggctaaccagattaattacctatttttaaaaaatcaaaactctggaggaatatatcaaaatccagaccctatacaacataatatccacaatgtacagatgtaacccaaaattacttaacaggaaaatgtgacccattctccagataaaaaaataagacactgatcctgaaaagacacatatgttagaattaaaagacaagaattttaaatcagttgttataaattttgccc

SEQ ID NO: 99764 - DNA, 550 bp, Homo sapiens
cccagcatgttatactacctgttcaggggaggtgtgcatgttctgagataatcacgccgtgttcttgagctttccaccgcagggaagtgaagtcatgcccccgcctctcctttatgcaagtagggcggggagtctaaacccatgcaggtagggtgtggggacccagctgtactctcccgccacctgtgggtgctgctcttgcggcagcctcgtaggtgagggataatgtggttcagccaacctgactacatccaagctgggatgatgaggacagcaagaaggcccactggctctgcaagtcctgtaggcctgggtccctcgagacaaagctcagatggcttctgtatcaaattcaaggacccagcatggtggctgctgctttgctcaccttcagaggcctggaagctggtgtttcctgcatgtgtaactgacggccccagtcccacatttgttagaaaaaaaccttcactttgatgagagtacagtactcctggctttttgtaattcaattgaaactcactgccactccctcattacagcagaagatgac

SEQ ID NO: 99765 - DNA, 322 bp, Homo sapiens
tacattctggagcagccttcagccctgatgggtgggagtaggtggataagtggcttagctttcttgctccttggagggtacaactctgggctagacgctgcaccatctcccagggtccccagcagccttggtccccagctgcccacaacagcctatcctcttggcacctgctcagtgacctggctggcttccttgttccttgactcacgtccccactccctactggtgtttcctaggatcacctaccaaataaacaacttctaccgaatttcctgtctcaaggcatgcattggggaaactcaacccaatgcagtttccagat

SEQ ID NO: 99766 - DNA, 457 bp, Homo sapiens
ataccaggaagagtaaaggggttgcacttatttttggataaagcatctgcacaacagtgtaccaggcacgaagcaacagatgtggcggagtgatgcgagtgatcattgatactgaagacgggagaacagatgagtcattgctaatagaatctcaagagaaataacaagcaacatggaattcagtatttgaatgagattttcttagaaaaagaaacaagtctatgaaacgaggcactgttcctgcccttgctgccctgagcctgtgggcctcattggtgacatccttggagtgcactctaagctggccttgcagctttagaaacgcaggcccctgcaggtgagcggcttgtcccgctcgggctgggttcaatccagatgcccccgtgcagccctctcttggcctcacacttcaatgtcgtcagtcccaacagggtgcaaggccagtgctttgtggttt

SEQ ID NO: 99767 - DNA, 438 bp, Homo sapiens
tataaaaagctgttaaaataggctaagtgtgagccataaacattaaactactaacgtaaatcaagtgtattttctatcttatacttccagggtccttcaagattatctgataagtaaaattaaagaatcagcacctaaattaaagtgctatacctaaaacaagaaactgaatcaaataaaatgaagttaacaggggaaaatgtgagatgcaccaaaactgagacaggtttatgacctgacagcaatgtgggtgaaaagagcaaggctgaatgtgagcagacctcatgtggagtatgatgtgcagtcttctataccccaactttcaaagagaccctgacaagctagaggggggcgcacaggaagaggagaagggcagtcaggctgacgaatgggcaacagccagaatctctctccacaggcaagaactacaaccatggc

SEQ ID NO: 99768 - DNA, 336 bp, Homo sapiens
gtgacagagtgagaatccatctcaaaatagaaaaaaaaaaaaaagacacatcaataggaacctcccaaaataaaatgtgaagggaaaaaagaatgaaaaatataaaaatgaacactctccacactgggtatctaagaactgtaggatagtgtcaaaagatgtacacatagttggaataccataaaaagaaagagaaagaagcaaaataaatatttgaaataataacttagaatattccaaaactaatggcaactaccaaatcacacatctaaaagctcagagaacaccaagtagagtaaataccaaaaaagctacacgtacacataggaaaatcat

SEQ ID NO: 99769 - DNA, 687 bp, Homo sapiens
aagtgtcttcctggggtaagactggattaggggaccctgctcggtcagtggtcctggtgatcgcctagggaaatagatctattctgctgggatctgggactgaatcctaggcaggtttgtggggagtaggatggtgagaggtgctggaaggcacgggtccacttcttaaccttccttttaactctgtgctgctgggtggaagctttatagtcaatgtcctctccatctctggccacattcccaggactcctgatcattagagtgactgttgtcccaagtggacataattataaatagctcccttcttttactgaaagtgtcctacagtggacaataatttagtcccctcctccagtggaaaatatactacacgcatgcaaaagctcagagggctccaggagtcgtcccaactcccctttctcagttccttgggatttttttttttaagtttgtcctctactagatcgcttctcattcaccaggatatcttagatcaaggctggcgtttgaagcctctgcctgagttcaagccccttgcttccggtgttcctgtccaagcccgcggactggaatctcccaaggaagttacgaataattcggggggggtggcgaaatggggggtggagtggggcgtgaaactgcagccttcacctggctaacagaagaggactcaggacgcccagcacc

SEQ ID NO: 99770 - DNA, 764 bp, Homo sapiens
  misc_feature (48)..(48): n is a, c, g, or t
gcatagcgtcgttcatccaaaaaaattagaaatataaaggaagttcgntaggaactctcgcctaggctggagtgcagtggcgcaacctgggctcactgcaaccttcacctccagggttcaagtgattctcctgcctcagcctcccgagtagctgggactacaggcacccaccaccatgactggctaatttttgtatttttagtagagacaggatttcaccatattggccaggctggtctcgaactcctgaccttgtgatcccaaagtgctgggattacagacgtgagccactgcgcctggctccttttgtatattttggtatgcatggagaggtgtttattgcctgaacatggagcccaaattacctgcccccaccccccacactggtcagcactggagctctggtgccaagctgacctctgggatcattttgtggattctcaagggctgtgaggggaaaacatttcaaattaggcaggatgcccagtaactaggagcacttggaatctccagcctcacaaacacaaccacgtctaaatgagattcaaagagaggaaaaattaccctccatgaatatcccttgaaattgcccagcagagaatactctggagcggcacgtggatgcatcccgagttctttggaaggaggatgtgaagagtgcccaggctggcaccccctggatagtatagcacaggcagtgtggagcctgatgaagcacaggcaggcgcgatgtggacagcagcacggacgtccggccgcccaag

SEQ ID NO: 99771 - DNA, 308 bp, Homo sapiens
taggcaaagaagggttgtctacacagcttggtaccaccattgatgaagggtttgagtgagatggggtagttgccactgccccaaagtgcttagtattactatcttagtctgcttgggctgccataacaaaacaccatggcctgagtagcttaaacaacagaaatttatttttggttctagagtctgggaagtccaagatcaatgtgccagcaaggtaggtttcattctgaagcttcttctcttgccttctaggtggctgccatcttgctgtgtgctcacatgacctctttgtgcacacttagggggtg

SEQ ID NO: 99772 - DNA, 577 bp, Homo sapiens
actttcatgatgcttgtgttaatgtaagtcatgcttagctctttcctggtggaatgaagtcctggggtccagaggccgctctagagggtcatgccttgtgtcctggtgctttcagaggccctagcgggactgctgtggcccctgcctggctgctgtagtccattagagggagctggcctcatggttcatcttagcctgtgccccggctctgtcgccttgtcatggagcctagtctccggcactctttaaactaaggctgctggccagggacaagcagtgttgaaggtggagaagggaggacctcgttggaagatggccttttccattgcattacttaactatatgacatctattagtaaccaatttatcccctcagtcttccaagaggcaggcaccaaagccgagaggccgagcagctcacctgtggccatgtgggcaagcccccgcctgctgctgggtcctcccgcctccgtggctcactctgagcatctgctccccacacagtttccagcacggtgggtgaggggccttgagtgtttgctgctgctgctgctgttcccaggatggaagaggagac

SEQ ID NO: 99773 - DNA, 537 bp, Homo sapiens
tgcctcccgggttcaagcgattcttgtgcctcagcctcccgagtagctagaattataggcgcccaccaccatgcccagctaatttttgtgttttttgtagagacgggatttcaccatgttgcccaggctggtcttgaactcctaggctcaagcaatatgcccgcctcggcctcccaaagcgctgggattacaggcatgagccaccatgcctggcctctctttaaacactttttgcttacacactgcttttggaatgaaaagaacaaggagacttcagtcatatcctcctggatttgaatgctaaggagctgcgtaacatttctgaaatcttcccatgtttattaataagagaataattctacctaccttgtagggttaaaggttgagtacgatagcatggaagaatttgcccagcacctagtaggctgtcagcgcctgttacctttcctttccccaatgctccctaaagctaagttcattggcccatcatgtagagtaatgggtccacaggcggtgaattacttgtgatgctcttcc

SEQ ID NO: 99774 - DNA, 236 bp, Homo sapiens
ggtggtggcagcaggatccatccttgttcacatgtgctaacagcaacagtagcagcagtgcagggggctggaggggtgaaaggttgcatgctcactggctgcagtgctagcaggtactggggtgcctgcctctgcacaggcattcccagcagcagtggaggaagcagagctcaggggcatgagggcccacactggtgtgtatgtggtcatgctggtggtggtattagcatggggtt

SEQ ID NO: 99775 - DNA, 875 bp, Homo sapiens
  misc_feature (374)..(374): n is a, c, g, or t
tgaaattctgaagtctcactgtgtcacccaggctggagtgcagtggtgcaatcttgggctcactgcaaccccccgggttcaagcgattctcctgcctcagcatcctgagtagctgcgattacaagcacctaccaccacacctagcttatttctgtatttttagtatagatgggctttcaccgtgttggccaggctggtctcgaactcctgacctcaagtgatccgcccaccttggcctctcaaagtgctggaattacaggagtgagccaccacgcccggccaaagggtggctgaaagttggttgcctcctaacttccaccaaaaaaaaattattcagaacattgttcagaaaacattattcagcacgataactnggaacaacatcaaataacctaaaagaatgaaaagtataccattaacaatgaactaatggaggcagtcaaaatatcaattaccaattacaggtccaaagataaacacagcagatatatgcacataatctttatattcatgaagccttctaaaaagaataaaatctttgttcttggccatttggaaagtgctgctacctagatctagggaatccaacagtcaacttcttcagaagaacgaatgaatttcaattacaaacccaaactgttgcaacatgaaaaactgttccaccaattagggatatcgtccaattctaaagggagaaattcacagctttcagcatgtctatgtcagccatgaactttggagtaatggagctgtccacagaactcaaaaagcctgaaaaaactaagtaaaataagagcctggatttttccaccaatttatttagggccactagcaaccaggaatgatttagaacagactatattttaatttagttt

SEQ ID NO: 99776 - DNA, 306 bp, Homo sapiens
agaagtagaaggtggaggtttccctgaagaagaagactcaacctggttccagagagactgccactcagcaactgcaagtatggccttggaatcggagagacttgggttcatgtcctggcttagccaagttccaccgaatgagttacttaaactcaccaagcttcgatttccccttctctaaattacagatactaataaaagcccctgattcattgggttgttgtgacaattacattatacagaatgtaggtaaagcacttagcactcttggcaaaaactaagtgcccagtaaatattaactatttt

SEQ ID NO: 99777 - DNA, 629 bp, Homo sapiens
  misc_feature (67)..(67): n is a, c, g, or t
  misc_feature (76)..(76): n is a, c, g, or t
  misc_feature (139)..(139): n is a, c, g, or t
attaccggtaccggtgttatcgatgcacaggataggtgaactatcaatgaatgatgatgagtaggtngggagaaanctttcgggactagtgggtccagcagggctcttacttaatttcttgtatcaaaatgaaatccangaaacatcaaatatataaatatttatttttaaaaaatataaaagttggagaaaaatattttttagaaggcttgcactgcagaaggccttctaatacataacataaaaccttgaatccataaaagaataaatctgacaatgcaaaatgtacaaatttcttgataaccaaaaaatggcataaagaaagcaaaaaatagagaaaaactgcaaatatatatgacaaaggattaatgttgtaacataaactgtgctgttagaaatcagtaagagaaaggcaaacaattctataagcaaacgggcaaagcacagaaacaaacatcacacaaaaagaatgatgaaaaggaagaagaaaggtaataagaaagaaatcacaaaagcaagagggagaacacaaattcaagcggccaatcaataacctaaaatattctcaattcattcatcattaaaaaatccatggacccggtgtggtggctcacgcctgtaatcccagc

SEQ ID NO: 99778 - DNA, 173 bp, Homo sapiens
aaagtgtctgtaccattttacattcccatcaacaatagataagggttaccctctggagagctttttaaaaattgtcatttctgtgccctacccacctgaggtctggcatggggcccaggaatctgcattttatgagctccccaggtaattcagatacatctggttcgtggata

SEQ ID NO: 99779 - DNA, 139 bp, Homo sapiens
taggaagcaacgcgaggtaggtgggcagctaaagcaagtacaatcaggaaagcaacgttttgaactgagactgcattactaaaaggaaccagccacatgaagatcgaaagtgcgttgtcagtatagggaacagctatag

SEQ ID NO: 99780 - DNA, 325 bp, Homo sapiens
cgcaggaaaattttacctttcctggaaaattggcaaatttcttctttcttttctcctcccccaactaacatttttcatcttcctctttgataacaatagctgcatcctgatccatctccttttggaattgactatggggacctggagaccttagtcccggtaattatgaggattttttttttttttttgagacatagtctcgctttgtcacccaggctggagtgcagtggtgcgatctcgtctcactgcaacctccacctccaggttcaagcaattctctagccttagcctcctgagtagctgggattacaggcacctgccacca

SEQ ID NO: 99781 - DNA, 726 bp, Homo sapiens
aataaataaatattagctgggcgtggtggtgcatgcctgtaatcccagctacttgggaggctgaggcaggagaatcacttgaacccgggaggtggaggttgcagtgagccgagatcgtgccattgcagtccagcctgggcaacaagagtgaaactccgtcttaaaaaagagtaccagtttcacatgttaatacaggcaaattctgtcaaactttgaagaaaaaactgtacccagagcattttaaaatggtaggtttatcaattttattatttgaagctacactgttaccaaaactgggtcagaaaactaccaaaaagaaaacttaccctcagagagaagcaaaaattctaaatgaaattattagccaatgagccaacctaatttagtaatacgttctaaaaataagtgatactgaatatatctgaaacacaaagattgtttatcattgggaaattgctgatgtatattacattgaaggattgaagaaaaaccatattatttctgtagatgggatgggagctaaaattcagtaatcattaattactgtttaatgtcctagcaagttacgtataggagaaaacttctttaatataatgtgtttaggctgggcatggtggctcacgcctgtaatcccagtactttgggaggttgaggtgggcagatcacctgaggtcaggagttgaccagtgtggccaacatggtgaaacaccatctgtactaaaaata

SEQ ID NO: 99782 - DNA, 370 bp, Homo sapiens
ggacatggtgatgacgttgacacagatgatgaaggtgatgaagaggtcgagatagtggctggtgcacagcgagtgaatggagcggcgcgtgggcgagtagtcggcatagtagggccggcgctgggcctctgcggggagggcggccatgagcgccgggcaggagggccgcccggcgctcctggctcctgcagactccattctcctcctaggtggccaagtgtagggtagaagttgggggcccacggctcatgtgaagatggggctggccctgcctcatggcagggctcacataagactggagaagggggactctctcaggaaaaggaccctgttctaggtgagatgcagctccctggggagctggctaggc

SEQ ID NO: 99783 - DNA, 859 bp, Homo sapiens
ggttccgctattgtttcctaatatggggaagaggaaaaagacttagtgctcaacagcgtgctgatggaagtggaagagcctgaagtcttacaggactcactggatggatgttattcgactcagtcaatgtactttgaactacctgactcattccagcactacagaagtgtgttttactcatttgaggaagagcatatcagcttcgccctttacttggacaataggttttttactttgacggtgacaagtctccatctggtgttccagatgttagtcatattcccacaataggcagcccttactaagccgagagatgtcattcctgcaggcaggacctataggcacgtgaagatttgaatgaaactacagttccatttggaagcccagacataggatgggtcagtgggcatggctcttttcctattctcaaaccatgccagtggcaacctgtgctcagtctgaagacaatggacccacgttaggtgtgacacgttcacataactgtgcagcacatgccgggagtgatcagtcggacattttaatttgaaccacgtatctttgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctctttacaattgttaacccgctaggctcctttggttagagaagccacagtccttcagcctccaattgg

SEQ ID NO: 99784 - DNA, 200 bp, Homo sapiens
tagcacccacccctgcaggtggtgaggacagagcagtgaaccagatgtcactgcgacagcctcagctgcagccccgagtggccacaacagatgcaactgccagctcctgagcccatggtagagcgccagcaggtcttctggatcacaacagttagattgcaggcggcagggacccttggatggtgagatggggcctcctg

SEQ ID NO: 99785 - DNA, 341 bp, Homo sapiens
gatataccatccccactgccctttccagcatcctctacctgacccacacagagagctgcatatagaaaggagccattcacaagtttatgtgaaatttaaagattttgatttcttcttccaggagaatttttttctacaaggctaatctcttatcatacaatgaaagcctttgttcctctattattaaacgagtacgatggttcagagagcaagtgggagtgttttgggggatttgtcaggaaggtttatttccctccaactatgctatatgggcaagtgccagcataaacaagaatggatgagggaatggggggttcttgttaatgggcacatagtttcag

SEQ ID NO: 99786 - DNA, 403 bp, Homo sapiens
tggtcttgttaacatcctgtctccacatctcatgatttctactcgatagagaagtcattatcagttcacattatcattgaagaccttcccaacttaatacccagttttgccatctggctatatttcttcccccagaggagtgcaatgttgttagttggttcagggaccaatctgagagatggggtctattcccaactttataactgcacttcttttccaaccctgagatgcttatgcttcagcggcagcctggaagtcacccttatagagacggagatgtcccgcatgttcccagatgtgctgccagctggcttctctgcctcgttctattcctccagttcaggggctcttgctacgtagaatgaacctgctattactcggaagatgcatgtctgacaccaag

SEQ ID NO: 99787 - DNA, 141 bp, Homo sapiens
aacaactttcccaccgctttttgcaggcgtggtggtcaccaaggactgtaggaccttgccccgagggtcccaggaatgtggatggtgtggggtagatcgtcattgcaggccccaaatccgtgtcaggggctcgggagccag

SEQ ID NO: 99788 - DNA, 384 bp, Homo sapiens
  misc_feature (371)..(371): n is a, c, g, or t
ggacgggagctgaactagatcagtgtttatcaaacattagtcaaccttcacctgctaccttcatcactggcttaatttcacaaagcaagtgccttggtttttagcttaagcatgattgtaagaactatatatgcaatggcaaatttaataactatttttttctgatacatatacacatctatatgtagtttattactacattacctaaaatcacttcatgtactctcagcaatttaagtaccacactttgggacactgaactctactattaggagatgccatgtagaactgaaagaaagctcatgaaataaagctgtatctatccagtagagggtcacatcagaatggggtgaaaatgtcgacgcggccgnaatttagtagtag

SEQ ID NO: 99789 - DNA, 122 bp, Homo sapiens
caatgtaggggaaaacatgtatgaccaaaagacgccttcttgaatgtgagagtggatatgacatactgggacactcagttttcccgtagtaatagggcagggatgcaggtgggtgtagggcc

SEQ ID NO: 99790 - DNA, 2334 bp, Homo sapiens
  misc_feature (1095)..(1095): n is a, c, g, or t
tttcctaaaattctagaatcccttaaaaaaaaaaaaactcatgtaatagtactcataaagtctactcatgattctccaacctccaggctggactggacttagcccagcctaaaagatgaaagtgtgtgtgtgtgttacatatagataacatatgtgttatatataggtattacacataacatctatataaaagtatactttttttggtccacattaaaaggattcaacaatctttttttactaaccccagacatcatacttccaaaagcacatctttaagatcctgctactgaaatttgaatttgttgtctaagctcattagagatgaaaaacaactgctcgtcatttacaattcatcagctggttcggagtaagaaaatctctctctctttctctctgtctctctgtctgtctgtccgtctctctctctctctctcacacacacacacacagagagagagagagagagagagagagtgcgagagagaccattataccccagccttatttctaacttaaattctaacattagatttgatgcagatattttagctgctaacaggaagtgttatctccttttctatgagatgcctgggcttccctaaagtggtgctcatctttttttttttttttttttggctataaatatatgaaagagtctgtcaagagtgcctgcagggaatgaaagtgaaagtgcagtaaagagcaagtttatgagttggcagcttgagtgactggctcctaaacagggacccatctgttctggggttgccttgtgattctctctcgtggatgccgtgcctgcctggagtcctcacatgcaggtggccagctgacaagggatgacactggtgagcctgccggtgtgtccagaccctcttaggtgggtttctgtgcagaatttcccccagatccggctcttcagaaattgtcagtagtaaattatccttagtaaatgtggacatgccactttagaaatcatgtgactccaaaacccatgactatttccaactccagcttttgagaaccaaatgccttctcaagtctcttcaagcccagaaggcaggctttacctcatctctaaagaatctacanagttggagctaaaaaaaaaaagattttttcacaggttgctttattttattttctatttaccctcccacaagcaatgacatgcttgacatgtccgttacatgtcaagcactggcagaaagactggggagatggaggtgagtaagatgcagcctaatcctcaagaagctcacagcccagtgaggaaagcaaatcaagaaattgtaattctgtgtgtcaaaagcaatcatgggtgaatattcataactcatcctgaagccagtgcaggggcaggggcagggacggccttgcagagaagaaactgggctgagtttgaaggctgattaagaggtaatcaattattaattctcagagaaggtgatgatttaaaaaaaccaaaaaagtaaaagaagaggtaatcaactaaaagaggggctgaagcagggcagcagcaggaggaagacaggcaggagtgtgtgtttctaatagacggaaaagcatgttcaaagggccagaggcagatcctgtaagggagagggcatctcagagttaaccatacattcagtatggctggactattatgtgcaagaaccacagagttcagagggaggtaggcaagggccagatgctgaacggcttgcaagtggggcccagagaaaagaggcaacagcccgagccacaccatgacaagaggtggccacaggagattccctgtgtgaggctgtgccggcattgcacaaggcttcttaattattgcatttgccattaggaggacaatatttttgtcattgaacatgtcctacaccttgtaggaaatccagcaatcctggcccctggcatcaatgccagtaacaccctctgcaggccctgtagcagcatcagcccccagacattcccagaagttccccctaagaaccactgcccaggagaaggggacagagaaaggggagcctcctatgagaattcccctagtgattccctgtggaggtggttcccacatcatcactgccaggggctaccaggctcatctgcccgaggagagaaggagaaagaggagattggcacagtggggtggccctttgacctctggtggaaaatcagcatctagtcatggagctccataaatcaatctgtctttctcactgtctctctctcatggtccttcccaaagcccctccctaccaagactttcttttttggttttgttttccaaagcaacatggcattcacgcagggcctggtaatgaaatgagattaaaaaaa

SEQ ID NO: 99791 - DNA, 342 bp, Homo sapiens
attgtaaactttgaaaccttaacaactgtagacttttctcctttacttatatctgtcatacatatctgacttccttgcagcttcttcgcaagggaacctctttccctttcttgaggcagaggctcgctcggtcgcccaggttggagtgcagtggatcaatctcagctcaatgcaacctttgcctcccaggttcaagcgattcttgtgtctcagcctcccaagtagatggaattacaggtgtgcgccaccacacccagctaatttttgtatttttagtagagactaggtttcaccatattggccaggctggtcttgaactcctgaccttaagtgatctgcctg

SEQ ID NO: 99792 - DNA, 848 bp, Homo sapiens
aaacgttcagttttcacatgattttgctgtagcaccataatgaatgtatttctttgatggaagaaagaagcttcatgaaataaactgcttaaggatttgaagttggagctgaaaacatgggctgctttgttcttaatgacaactgctttgccatctaaaacatttctcctttttgaaggatctgtcttttctcttccagccacaaccctcgagctacaataacaggctcatgatttttttagatgccaaggttatgaatactcttttatgaatattttcctttgaactcatttctcttgaagaagaaaaatagccctacatattgcaggattgacaataacagacaaaacgtacaaattgttctcttaggggcagtaaaatgctccaaaatgcacatagaaaaattccaaatgcaacctgatgtttatggagcactgcctttgcagctataatttttagaaagtaatatttctgactgacatgaattatacagagcatatttcagagactaatatcaggttaatgccttaaaatgtctccgtttatgacatcatggctgcttttcctatatcagtgcaaactcttagtgagtagaatttgaggatatgtcttttcaaaggaagaaaaccttcactgaattaagctgcttatggttttattttttcttttatcccatttcaacatatccaccaacctcctctaaaaataattcaactaatgtgaactcaacagattatagtagatctcttattaatttcattttgcctccaaaggagcttatcatttaggcttataattatgtatgcagtactgtcgactaatgtttaggttcctcattaaaacttcat

SEQ ID NO: 99793 - DNA, 379 bp, Homo sapiens
agttcttcctccatttttgacccttcagcattcccttactttcttgcaggtgcagctaggcatttattagactggattcagcacttctagaaatttgcaacagctgtttttcatattacatggaaacctatgttgttgaaaaacagaagtatccaatctgctgctcaataacctaaaagcttgccatcacaggaaccccttcttaacccacagagttgaacgccaaggtgtattttcacacgtagcatattcttcctcatgtcctcatactgagtatgaagagatctctgatgaaggccattcctgaggaagcattttcaggctaactacagctaccttatcataaaaaaccagacagtatttcgcagcgtgtgtctgg

SEQ ID NO: 99794 - DNA, 338 bp, Homo sapiens
taaatgcccatcagtgatgcaactaagagattttacgaaggcatagcaggagaaaagcaagtaataaaagtaaacaaagtgaggccaggcacggtggctcatgcctgtaatcccagcactttgggaggccgaggcacatggatcactttaggtcaggagtgcaagaccagcctggccaacatggtgaaaccccctctctgcttaaggaggtcgcctgtagtcccagctactcaggagactgaggcagcagaatcgcttgaacccgggaggcagaggttgcagtgagccgtgatggccccagtgcactctagcctgggcgatagagtgagactccatct

SEQ ID NO: 99795 - DNA, 382 bp, Homo sapiens
tgacaaaattgcataacgatacaattctcatgcatttccctgtcattaagcaatgtgtgattaattggtttactgatgaatgtaattccaagaatagagctaagggaagaattaaagagtcaactatgatttagaatcgtatatcattagattgtgagttctctgactttggcaattcaaaagctccaccattggtaagtgagaaaggataccttaaatggaatttttagcatcttttgagggacctcgggggaaattaaatgacatgaattagttttttacatcgagatgttttaagaccttaattttttatttgttgcattacatcactcatacattgaaaggaaacaattttgattataaaagtgctttatagagagaa

SEQ ID NO: 99796 - DNA, 772 bp, Homo sapiens
ttgcaggtacttactaaatgtttgtcaaatggatttgaatattttgtgaattttatattcacataaaggattcagaagaaagcgcaactgagaaatgtccaaatatggtgaagacacttcttctagagtgaaagacataaagaaaataggctaactcctctggggagaggaggaaaaacataatttatatctctatgtataatgaactaaaactttattgccaaaactttaaaaatgtttgtttagatggaactcagcatctaaacttttctaaaaacccatgatacgtgagagaaacaaaatcagtcctaaaattacggtctgtaagcaaggagactttttttctagaatactatgaaacaatttttttaatggatcatctgttctcatgatatttctattactccttccagaatgggtttacatattaaataacaaagcagaagctaccatttccagggaagagaatgcatcaaattatttatgattttatcaatcctgattaactgcacagccacaaaatcaacaccatccttgtcactcctacaggcgcttgatgcctgagttctacatttcctgttttattcctgtgcactcagcacatccatccactttagtgaattgatttcattgaatactgttatgggttgaattgtgtacccctaaaattctaatccccagtacctgagaatatgcttgtatttggagacagggcccttaaagatataattcagttaaaatgaggccattaggatggccagtctgactagtt

SEQ ID NO: 99797 - DNA, 429 bp, Homo sapiens
aggtaggtgccatgtgtgggtacagagacttcagaaggtaggtgccatgtgtgggtactatttgccataattctagcttcttataagttttcattgaaagcctagcatttgaaatcagctgctccaagagggcagtaatggagtgtatcactgtgtcctaaagaattcagaacaattttgttttggtctggttagttaggcctttaatttgcaacaggttacctcagctgtgatttatatgggttcatacctttttatttggctctctgagtcccagaattgctctgctggcactcttgtgttagcatatatgggttcgcttttcagcttgctttttcagttcaccactcacaatatcttcatcaaagcagaccaattgtacatgatagttaccctaaatctctgttactttccataattaagaaagtt

SEQ ID NO: 99798 - DNA, 438 bp, Homo sapiens
actgacggcatgcatgtgtgtataaaatccaattataagtgtttcccttctctacacctgggcagaacactgtactgaggaaccaataaaaggagatggtctccaaacacaggtgggcctgcaccactgctcagccatgtttacaggccccactcccaaggctgtctttacaagcttcctaccttattcctgataaatctgtttgtttcacaaaggaaaggagacaatcaggctggaaactcctttccgtgcccgtgactcctgtcctgtctctcaaaaattcttccctaacctctaagagtctctccatcccatcaatgctctgaaaatccattccttcccatgtcctcatttttgagacaaagtctcgctctgacacccaggctggagtgcagttgtgcgatgatggctcactgcaaccttcgcctccaggactca

SEQ ID NO: 99799 - DNA, 532 bp, Homo sapiens
tggggaggagtccctggcagccacagccaggcactggtgccttatcttgttcagcacacactgggtctctctccctagttccaggccccttgccctcgcttctctactcatctgggatagaaatgcacctccaggcctctgaagagaaactaccttttccctctttcagccaaaagggctcaagccagcactcgctttgtatgtcctagaagatgagcatgcttccctctggctctctatagcagtgctctaatgggacaaagtcactgtgtgctcttgctttctctcctggtctttgtgcgtgatagtccctctctctagaaccctcttcctcctcctcattcctctgagctaatgtattcgttcttctgttcagccttgacatcactccctcagtaaatttctgaccattcccaagcctggattagctgtgtcttctgcatgcaccctgtaatctggaatgatcattggtggcactgattacactgctttatcattgcttgctgtttgtaccacctgctcaaaaaagaaa

SEQ ID NO: 99800 - DNA, 540 bp, Homo sapiens
taaattcttcccaccccagacccctctcctgagttctagtcctgtacatacaactacctaaagggcatctccactggctgtcccacaggtgtctacaagggaaataatttcctcccataatctggtcatttctactattaatatatcccattcctccaaaggacaccatctacccactaactggtgccaggatcctgggactcatttcaggttcctctctcatataaccacctaagaagactttagtttgccatttcaggagcatctctcaaatcagtaacatcctctcatgtgcaccattattctgtttcaggcccaccttccttactgcatggatcactacaatcacctcctgatatggtttggctgtgaccccacgcaaatctcatcttgaattgtagctcccataattcccacatgacgtgggagagacccagtgggaggtaaatgaatcatgggggtgggtctttcctgtgctgttctcgtgataattaataagtctcacgagatctgatggttttataaaggggagttcccttg

SEQ ID NO: 99801 - DNA, 271 bp, Homo sapiens
ctgaagggagcatgggagggtcgggaacggggcagaagccttgtgtgcagagggaaatggccctctaggaaccagagcccagggggctttgcttatagtcagatgctgacccttggggacgggcagcagagagcagctcccagccctgcctgctaagacatcaggagcaggaattccacaaaccagagtcctgtggtccagtgaattgagagaggctgccaactatagcgcccccttctcggagaaccacagatactttggagttccaaag

SEQ ID NO: 99802 - DNA, 322 bp, Homo sapiens
agatgcttaagtgccttatataaaatggtctgggctgggcgcatggtttgtgcctataatcccagcactttgagatggtgaggtggccggattgcttgactctaggagttggagaccatcctgggcaatgtggcaaaaccccacctttacaaaaaataaaaaataaaaaaattagccaggtgtggtggcacatgcctgtagtcccagctactcaggaggctgaggtaggagggtcacttgaaccttgaggttgagtctgcagtgagccacgaatgtgccactgcacttgggtgacagaacaagaccccgtctcaaaaaaaaa

SEQ ID NO: 99803 - DNA, 287 bp, Homo sapiens
ggtcagaagatttatttaggaacaagtaggttttaaaccatatctgtataattgtgtgaagctgaagccacatgcggtaatcgcctttaaccaagtcatgtgactgctatagacccgtagaatctagcacaacatggtattctaatgcaaaaattggaaatgtagaggagccaaacgttacatcatcaaagtgtcacataaagttattatggtctgattctctgtatttgaagaaaaggtataaagaaaattaaaaaatagctgaagaaaagtggcattgcagagac

SEQ ID NO: 99804 - DNA, 215 bp, Homo sapiens
atatgacttttctaggaaaacttttgaataacacttacatatgggaaaaatgttttaaaaactgggtacatattgggatagaaagaatattcaggtacgcattaaggatatttctagatctcttgtctcctctgggtacaactaggtgtacagagaaaaatattttaggagttttcatttcaaaataaacagaacaggaaaataaagaattcatt

SEQ ID NO: 99805 - DNA, 164 bp, Homo sapiens
cagatgatccatgaaataatgctacacccttaaattccagaagatggcatggtttttccaacctcctgtggatatggggcatgatcaatctattatatatgattaatacaagttcatgcttcttgttttatggtgaacaacattaaagaatccaatttagattg

SEQ ID NO: 99806 - DNA, 306 bp, Homo sapiens
atggtcattcataattcaggtggagatggttcatacacacacccttccatttgttgggtaagacgtcaacaaatagtagcaaattatccacatgcttccttggattcctgagttcactctaggacataattatcaagttcacaaatgctctgaagtcccaggaagaaagagtccttcagctctcataaattatgattcaacaaggaaaaaaaaaaagactttgcaatggaaagaacctcacactctattataattgccacttacaataaacatttggagctgattattttctcagtgtattttgta

SEQ ID NO: 99807 - DNA, 348 bp, Homo sapiens
ctgaatatcgagagaactgcagcaaaacacaacacagacaaacctctaaaaaataaagaacatctcaaaacaaagattgaaagtcatgccagagacatgaagcacaccacgtacagggaacaagcttaaaaattatagcaggaccagcccatgctacatggtgagaccctgtctctacgaaaaaaaaagaaactacaaaattagccaggcatggtggcacgcacctgtagtcccagctactcgggaagctgaggcaggaggatcacctgagcccaggagtttgaggctgcaataaattgtgatcatgccactgtatcccagcaaagtgtacagttctctctccctgca

SEQ ID NO: 99808 - DNA, 370 bp, Homo sapiens
gtttttcagagacgggatcatgctatgttgcccaagctggacttgaattcctgggctcccaggaattgaattgaactcctcagcctgccaaatagctgagactgcaggtgtgtgccaccacacccagctagtcttaaggcttttaaaacgccatctattcccatgtttcacaatcttggctgctagttaaaagtttaaagtttccccactagaattactggggaaactttaaatcaaaatctctctcttcttttttttttttttttgagactgagtcacccaggctggagtgcagtggggtgatctcagctcactgcaacctctgcctctcaggttcaagcaattctcctgcctcagcctctggagtagc

SEQ ID NO: 99809 - DNA, 191 bp, Homo sapiens
aaaaaatagcaacgattaagaattctgcatttctttctcatattaagaatactttagaagtagtggtacttggatttctacagtgattactattattccagcagaaaattcatcagttggtatcaatgaaatgcaagccttgacaaatattttattttggggtcttcgtataacaccatttctaaatccta

SEQ ID NO: 99810 - DNA, 815 bp, Homo sapiens
gtaccatggaattctgggtcatcagtttttatcatttactcttgccttcaagacttgcttgagcctgatgccaaagataccactttcataatatgatggatttctgccacgctctgccttatgatgtggatgcaaccatgatgcccatgatggacatctcaggttgcatggtcccttggtgtcccatagtgaggagctcaacttctgaggagacccagtagcattctgagagctatttttcagacagagagtcaaggagaacataagtttgatttagattctgagaggtatgtgctgtaatcatcctatagggtcttgttagcatctccattcagcatccacatctgccgtgaatatctccacggtaatcagatatggcctcagaggcagagcagctagaaccacagcctagacctgctgcagagcatttgtctctaggttcactcaaactggcatactccagagtcacctgataacaaattggaagcagtagtccacattttctttgtccaagatccaaaaagactcatcggcttctatgtctcttttttagtaaaagaaaatgtaagatgcaggctgggtgtggtggctcatgcctgtaatcccagcactttgggaggctgaggcaggtgaatcacttgaggtcagtagttcgagatcagcctgatcaatatggtgaaatcccatctctactaaaaaatacaaaaattagctaggtgtggtggtgcacaactgtagtcccagctactcaggaagctgagttgggaggatcacttgaacccaagaggcggaggttgtggtgagctgagatcatg

SEQ ID NO: 99811 - DNA, 213 bp, Homo sapiens
atctgtagggtgagagaacgaacaaacaacaggtgagatgcacatgtgggtgccagagtggacccaccaagcaggcgtgtgggcctacagctcgaaggagagcctgaggccaggctggagcagctccctggagctgagacacacattagcggctgtgcctggagcctgcaacgcaatgccaccagctccagggccactgcctgtcccacctga

SEQ ID NO: 99812 - DNA, 373 bp, Homo sapiens
cagctgtcctttattcctgcccccagccagagtgcggagcaaagatctgagggccatctttgtccagtgagaaacgagcccctgtggagctgctggtcccaggttccgagtgactggggctgtgaaccttcccttccagacctgggcccctcctcaggaactccactgccttctgcagaatcaattattgatgaggtccctgcagtcaggagaatcccagcggagtctcctggccaccattggcagccttcacaggaggcgaaattgctgggacaagatgagctcgttcccgaagacagggccagtgagttgtgccaggctgtggcttccagtgagcagaggcctagtgtaccctcaggctaggggtgccaac

SEQ ID NO: 99813 - DNA, 362 bp, Homo sapiens
ccatcctgtaggttgtcttttcactctgccaattgtttcctttgcaataacgttaattttttaaagaaaagtaacttaaatgcttgacaatatggaatttaaaatatggtacattcaagctgggtgcggtggtgcatgcttatagttgcagctatctgaaggctgaggtggaagaagatcgcataagcccagaagtttgagaccagcctgggcaacataatagcaagacttagtctcttttttaaaaaatggtatattcaatttagggaacaccatacagcagttaaagacaatgacctagatgaacaatggttctcaaacttcaatgtgcatcacaatcacctgaaggacttaataaaaat

SEQ ID NO: 99814 - DNA, 552 bp, Homo sapiens
agggtctcactctgctgtccagcctggagtgtagtggcgtgatcgtggctccctgcagtcttgacctccggggctcaagtcattctcctgcctcagcctcccaagtagctggggctacaggtgcacaccaccatgcctggctaactttttattttttgtagagatgagatcttgctatgttgcctaggctggtgtggaattcttgggctcaagtgatcctcccaccttggcctctcaacttaaatactaaaaagtaaatgtcacatcattttcatgtgtcacaaaatattcttcgtttttatttttctcaaccgttctttgtttaggggtcacatgaaaacaggcagtgggcgggacttggcccactggccttagtttgcccagccatggtctcagcttttagatggataggaatgccttatcctacctcaggccaagtacattgaaaacttggagagtagagccctggcaaacgtggttttcaaagcttccctgatacccagcaattcatgtgtatacccgagagaaataaaaacacatgtccaccaaaaa

SEQ ID NO: 99815 - DNA, 2030 bp, Homo sapiens
acctgaagaaaaatgaggacgaaagagcaggttgagagaaaaaatacccggactcgtggaggagatagataattcaggacagaggaaattctgtattctatgtagtatcctcagggagacaaagtcgagagaaagcatttttagtgctaaattagattgctaagaaagaacaactaaaacgaaataaatagttattagaatgataatgttattgttaaagttagaaattcaagggaagacctagcagaaaatagaagccgccacagatgcgaatgacgcctgaacgttcagtgtgctccctgtccacacacagccgtgggccaaggaagccttactgtgctcgaggtatttgagcccagcgtttttccagtgctggctaattgctaagctgtgcagacacggtggtgacccctaggaagccaaggttgaaaattaaaataggcatgtgggaaggaacggggtggccacgagctatgagggagatggatttcacggacaaccagacaggcctcggtggtaacaacgaaagggaaaacttagaatccagaattgctacaaatgtattatctaaaatacaaagaagtatgacagtgtgacccgtactgaggaagaacatcatcagtagaaactgtctgagtgtccagatgttgaatttagtaaaggcttggaaacaacttgtggatggagcagtagaaattatccattctgaagaacagagagaaaaaaacaagaaaaatgcacagagcctcagaaacccgtggtacaacatctgctgtaccaaagcacgtcgaatgggggttccaggagagaggaaagatatttgttacaataatggttaaaaactttccaaattttaattaaaaaatatgcacattcaagagcacaggaagtttgaactagaataaatgcaaagtcacatcatagtcaaactggcaaaggccaaagagaaaatgttgaaaggcctcagagaagaatgacccatcccatgaaaggggagcttcaataccgccagccactgacttcttagaaacaatggaggccagaaggcagtggagtggcatactcaagctgctcagagagaagaaccatcagccaggaatcaaaaccgttctacacaagtgaaagggaacgaacgacattccctgagaagcagagactggtgggattcattgttggcgaaacctgccttaaaggaaatactaaaggaagaccttcaagttgaatagaaatgacaccagacggtaacttgaatcctcaggaaggaaggacaggcactgcagatagcaagtgtaggttgacgtcaatatcctgtaaatatctctcctcacatcttaggttttactggaactacgattgtataaaataattacactgttgtcatggtatgtggcataaatggactgcacaaagaagacagggaataaagctgtgttacaacagttttatattgtactggacttgagctagtatcatgaggcatacggtgatccctagagcaaccactaagaaagttgttttcttagtgttctaaaaagtacaaataaattaaaatggtatgctaaacatatgtaatttaaaatcaaaaagggaagaataaaaaagacacaacaaagcaaggaaagtaaatccaactgtacgtgtaattatatgacatgtgaaaggtctctgtgccccaaacagacagggcagattatcagatagaaaaacaagatctaactgtatgctgtctgctagagaacaggaaaagacgcagcgtacaaacatcagctgtcataggagagcttgaatggctgtactcataccagacaaaacagatgttaagaaatattagaaaccagcctggccaacatggtgaaaccctgtctctaacaaaaatcacctgggtgtggtggcgcacacctgtaatcccagctactcgggaggctcaggtatgagaatcacttgaactcgtgagatggaggttgcagtgagccgagattgcgccactgcactccagcctgggtgacaaaccaagaccctgtctcaaaaaa

SEQ ID NO: 99816 - DNA, 533 bp, Homo sapiens
caatttgtacttgttaaacttaaatataaatgattcctcacccccataaaaaaccccagctgttctggatttttgccaataatatagaataccttgtttctaaaaagtgtggtccttggcttaacatcataagcagcacctagaaatttgttaaaatgcagattctcgggtcctaacacaggactagtgaatcaggagctgcattttaacaagatattcaggggattcataggcatgccataatttgagaagcacagtgttactggtgtctctgaggacgttagtagtatatctgctgtttctctttgaaatatagtgaaatactgatactgtagtatacacattggaagagagtacttagagcaggggttcccaagtgctggactgtttgcatcagattgacttggaagctattttacgtacgtaatactgtactgtttctcttggaaccagctgtagagtttccaattcagttatcttggtgtctcagttatcttagtgggatgtgagaaactggatatcgttaaaaaaga

SEQ ID NO: 99817 - DNA, 243 bp, Homo sapiens
agccaagatcgcaccactgcactctagcctgggtgacaaagtgagactctgtctcgaaaaaagaaaagaaatacctgagactgggtaatttataagaaaagttcaattgacttatggttctgcaagctatacaggaagcatggcagcatctacttttggagaggcctcaaggaacttttactcatgccagtaggtaaaggaggggcagccgtcttacaaggcagaagcaggagagggaagggt

SEQ ID NO: 99818 - DNA, 309 bp, Homo sapiens
ccagtaatatcagtatcactgagaacttgttggaaatacaaattctgaggtgcttcttccaaaattctagggatgaaacccactcatctgtgttttcgcaagccctctaagtaattctgatgcacgctaaagttaggaaccactactcacgtctttcacaccctggcttgtcggtcgggcagtaatttaaaatgtattttcaaacatccctaactaccttataggaactgatgaaatctcttcacttacaataacactctttacaataacgtcttgttgtaatcttagaaatactttatgaaattaggt

SEQ ID NO: 99819 - DNA, 821 bp, Homo sapiens
atttttattaaaaattattagcctactgaaatcagaaggatctttagaaattgtctagtacagcaatactcacctctttgttactttaattttaaataagatcctctgtataataaatacccacatttatcagtacctacataccagtggttatattgataattataacaggaagttactgaatttttttaaaaattccagatatcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatggcgccactgcactccagcctgggcgacagagcgagactccgtctcaaaaaaaaaaaaaaaaaaaaaaaaaaaaaaaaaaaaaaaaaggggggggggcaaaaaaatacccggggggggccccaatttagggtgtacacccagggttttgttttacaacggggtccccaataagtaggatggctttaacaaagtaaagaagtgggcgagataaacaaggacggtgcacagggaaaactgcatgtggacttttgtgaagagcctatcatggtggaggacaattatggacaccacctcaaaatagaagcctagggaaattaatttaaggggtaatgtggtacacgatattatgggcaagaatggacaaagtatagaattacgg

SEQ ID NO: 99820 - DNA, 446 bp, Homo sapiens
gagggaacgactgctgttgctgatctgaagaagagtcacactcacgacagatgtcttgcggagggcagacccaccaacgccactacttggaaagactcagaggctaaagccatgaactctggcacaccacagcctctcgccaaagaatgcttcatgagacatttttaaatacccaccatcccataaagaacaggaaaggaaatcccactgtcagccccaccctgatcccactgtcagccccaccctgggccagtctcctaccacgggtcttccgggagaagggccaaagcactgctctctccaactgggcatctggtgatgtggcctggcttcctggctgggccacttcctccactgtctcaaagtggcactgcccttactcaacaagttcctccacagccagaaatgaatgcccagactgtaaggaaaggtcacccgcaaccctg

SEQ ID NO: 99821 - DNA, 138 bp, Homo sapiens
ccaccagcccaacttgtcccatctcatccatatcaatttatcccatccatctcttctattcatccatcccaatccatccatctttattctgtgtcatcccatcccatcccatcccatcccatccatctttattctatg

SEQ ID NO: 99822 - DNA, 464 bp, Homo sapiens
gtatctcacctgccctcactcaaggtcagccacagtggcctttgtttaggaaactgcacacccgctcatacctcagagcccctgcacttgcttctctctcctttgttcttttcaaaaagctctttgaagcttctactcaagtgttactgctcagcaaggcctcctaactatggtcattagaatcccccaactcaactccccagtgcccttcacatgttttattttttaccataacatttgccacttttccagaataatgtctttatttcgtttattatttcgccctacctctagcaggagataaccccatgtgggctgttgtacccctgctcctagaatattgtacatgctcagtaaacgttggttggttgagtaaatgatataagcaagccacatgttcactgggagccacagtgaaggcaatactagttaagtaccaaagtaaccgtaacagaggggtagtt

SEQ ID NO: 99823 - DNA, 304 bp, Homo sapiens
gctcatggcgagtctagagtagagcccacagcaccgacagcagaggaggcaaaaactgacctgcttagaggaacatatacagtcttatatgcaatctttagaaaagaaaagctgaaaaacaagttaggtatccacttatagctgcactgctcaaaacacacactagactatgaaggcgtataggaaaaaaattctcattaatttattgattacatgttaaaatgacaatatttttgatatagtggattacttaaaatatatcaattttcatgtttccttttttaaaaactaccctactgtgggt

SEQ ID NO: 99824 - DNA, 551 bp, Homo sapiens
agtctttcaccattgagcacgatattcgctgtgggctttccacataaggctttattatgttgaggtagtttcctcctattcctagtttactgagtgcttgcatcatgaaatagcattgaagtttgtcaaatccttctctgtacccattgcagtgatcaggttgcctttttcccttcattctgttaatgtgatgtattacactgatccattttcgaatgctgaaccatcttgcactgttttggtttgctatttgtttgtgtgttcgtttttcattgaagccaaaaagccatcataatttcagagtttcacgaagtatggagtggtgtttttgttgatgttgggactggggactggctagcaccatctcgttgaaggagaggggtcatctctttgcttctttttcaagtctcctgaagagttgaggagaaagcctcacccctgttgttatcctgtcttcagcaaccctcttgcctactaatcttcctaaagaaagagagaagggctgcaggctcaggtcctcggcaggcgctagtataaagcaagacttttca

SEQ ID NO: 99825 - DNA, 228 bp, Homo sapiens
tgctgggattacaggtgtgagccaccatgcccggccaacttctttccctttctaagtacttttgtctctgacttcctttcacaaagggaaagacgaaaaccttctgaacaaattctaagagacgtatcagaggagatgctatggcatgtcactctgccatcataacacaatgtggttatgctgaacagcaccatgctgggtctcgctctgtcgcattttgctggtcag

SEQ ID NO: 99826 - DNA, 270 bp, Homo sapiens
atttttaccttatagtatagtgttttcacgagtttttttttttaatactttaagttctggaatagttttcacgagttttaagagactcttcttggcaaacagttcaactcagagaaaatacttttaccagcaaggaggtataccttgttatatcggtctggggatgtgacttgacagttcaccttgccaggaatatctctgtgattttttgtttgtttgtttgttttgagacaagagtctcgctctgtccctgaggccagagtgcagtgg

SEQ ID NO: 99827 - DNA, 184 bp, Homo sapiens
tgatactagaaaaggaaagtcaaactaagaagacagtacttttgtgacaggaaagaatttagaagaaaattcatttaacaataaaagtttgttactgattatcaattcttttccgaccatgtcttcaaaggatgaatctggtatttcagattggaaaaaaagttgagcttctggttgcttctct

SEQ ID NO: 99828 - DNA, 524 bp, Homo sapiens
caataataaatctagataataacaactgctggcaagaatagggagaaactggaaacctcctacaatgctagtggggatgtaaaataatgcaggtatactggaaaacagtttgacagctccaatgaaagttaaaggtaaactaatcatataagcaacaattctaatcctaagtatctaccatgaaaaatgaaaacatatgatcacaaaaggactttacataaatgtttataatggcattatttatattaatcaaaaagtagaaacaggcggggcgcggtggctcacgcctgtaatcccagcactttgggaggccaaggcaggcggatcacgaggtcaggagatcgagtccatcctggctaacacagtgaaaccccgtctctactaaaaatacaaaaaattagccggaagtggtggcgggtgcctgtagtcccagctactcgggaggctgaagcaggagaatggcgtgaatctgggaggcggagcttgcagtgagccaagatcgcgccactgcactccagcctggg

SEQ ID NO: 99829 - DNA, 627 bp, Homo sapiens
acttcttcaccctactccctacagtgcagacccccaaggggcacagtggcctgccgcctcacccacagaagccaggcactcgggctcaggagacaagcaggtccaggtgtaactccctcccccccgcctggtaaaggtgcgatagaagcccatggtacaagcatctgggtcctcatccataagatggggatggctccatccactccagggatgtcagctaaaatgaaacacagcatccgaccacagggagccgggaataaacgaccgcagcctcacttccttttctggccctgtggagatgctgctctgcccacctgagtcggcttctgtcttcttgccaggccctcgaaagtgtacctcctttccagatcctgctaaagctccattcaccccaagaagcctcccttccccagcgttcgggagagatcatgcggacagggaacccagctcagatgccacatgatgccctggaaaaatggcagccactgttatccatgcagttcggtgcttggatttagactcacttaatgcatttctgaatgctccctggatcactgtgatcagagagtaagcacacgaagggcagggacccttttttcctggtatccctgacagagctcgggccca

SEQ ID NO: 99830 - DNA, 584 bp, Homo sapiens
cgctaccctactccagcctgggtgacagagcaagactctgtctcaaataaataaataaataagaatcagggagagacagaaggtcacatgacaacgaaggctgagatcgaagtcatgcagctgcaagccaaggaaagccagattgccagtgacaccagaagctgggggaaaggcccaggtctcccctagagccttggagagagcatggccctactgacacctggattttggacctccagcctccaaaacacagcagagcagattcctctggctgctgtgccccattaccacaaactgggtggtttaaagcaacaaatgttttctttcagctgcggaatccagaagccccacatcaagatgtcggcagagttagttccttctggagactctgcaggggtgtcacacgcctctctcccagcttctggggctgccagcaatccttggcactcctcggcttctagatgtgtcatttccatctcagcgtccatcttcacatggcctccttccctgtgtggctctgtgcatcctctcttcttctcctgaggactccaatcattgcattagaatccaacctactccaatat

SEQ ID NO: 99831 - DNA, 434 bp, Homo sapiens
acttttcttatataccatctccctttcatcacagcctgcattttagactttatatctgttccaaagtcttcttataattattattaacaataatactttgacaaacaaaaacaatgttaacagataataaatatttggtgctttctacacgccagtcacggtgctaagcacatcttcattccactctcacaagaaccttataaaggttattctaatgattacaatcccattttacagatgagaaaatggaggctaagggagcttggtgggtttgtcttaagtcacaacgctagacagacagggagctgatgttctgaagcaggtgggcctccaaagcctgagaccagtgtgccgaatgccctttgaagcaggcgtcttagaggccagccacactttaagcccatctcagtttgctgctggcaaatgtacctagg

SEQ ID NO: 99832 - DNA, 211 bp, Homo sapiens
tcccttattaatagcacctgacccaatttaggataagcctaaaaaagggctattccccataggggcttataggactagtttcatgctcagacaggaactttcagatccacctgtgcagaaatggactaaatacataggtggggttcactctgcaaaagacttagagaagaggaggaaagagttttaagtaccagtaactatgcatttaaag

SEQ ID NO: 99833 - DNA, 514 bp, Homo sapiens
ctaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgtatcaactcca

SEQ ID NO: 99834 - DNA, 296 bp, Homo sapiens
tttctgccatgaactaattgcaatccctcatctcattcccagagacactgccaaacaaaagtactgctagaaagagacccagaaaaagatctcagaatttgatatcaaaaataaaaaggtacagacattttccagtagcagttgaactatctcaatcttacttctttttaattcaaaatggcttgtgatttcattgtacataatttttaaataaactttaaaatctgaatggctcatgaactgtgaaatatttctgtcaggccaggcacggtggctcacacctgtaatcccagcac

SEQ ID NO: 99835 - DNA, 187 bp, Homo sapiens
attttcaatggcaaccttgagcacccttctcttggcaaagtgattttagcagtgtcctggttaaacatcattccattgaaatgaagtagcagttcttaggggatttgacctatgtgacgtttagaccaaaaatgctacaaagggtagaattgttgaatgaccattgtggtacaaatgcatacattga

SEQ ID NO: 99836 - DNA, 506 bp, Homo sapiens
tatactggtaatgattatgatcctgtgtatctatataaagtcctttggttcacaaatgcttttatatcttttatttcatattagttgtatcctgtcaataatcctgtggagtagaaatcacagcaaaattaccgtcagttctgactatcactagatggtatctttattttctttgatttgtgcttctacatgtttggaagttgattcgtcacagctcacaattgttagtatacatattttaaacttggtatgttaatattgaccctggttgggaggaggattggaatgatgctaataaacttagcagtcttggtatattttacttgtggtgatgtgacataaccccctaccccagaacccaactcaccctgctctctattcactgagtccccttccttctgtaactacccagcccaaaccagtatctcatctctttcctcactcccattctcgttagatattttattatttccataaattcaactgtgataaatacccatggtacc

SEQ ID NO: 99837 - DNA, 376 bp, Homo sapiens
gctcttgtcgcccaggctggagtgcagtggcatgacctcggctcactgcaacctccgcctcccggattcaagcgattctcctgcctcagcctcccaagtagctgggattacaggaactatgtactgaagatttgggggcaaaagaggaccacatctgcaactaactggagatggttcagaagatgatgcacacacactcaagcatatcgagagagaaaggggcagaggacacagaaggccctgagtttaatgtgcatgttttggggaatttggaagaagagcccctgataattcatccttcattattcttgcaacttttctctaaatctgaaattatattaaaatataaagttagaagaaaacatgaagagtaaaa

SEQ ID NO: 99838 - DNA, 327 bp, Homo sapiens
  misc_feature (19)..(19): n is a, c, g, or t
  misc_feature (23)..(23): n is a, c, g, or t
  misc_feature (58)..(58): n is a, c, g, or t
agagaagaaagtaaaaganatanaaaaaaagatgatttaaaaataagtatataaagangcttgagaactatgtactgaagatttgggggcaaaagaggaccacatctgcaactaactggagatggttcagaagatgatgcacacacactcaagcatatcgagagagaaaggggcagaggacacagaaggccctgagtttaatgtgcatgttttggggaatttggaagaagagcccctgataattcatccttcattattcttgcaacttttctctaaatctgaaattatattaaaatataaagttagaagaaaacatgaagagtaaaa

SEQ ID NO: 99839 - DNA, 817 bp, Homo sapiens
gacaatggcgtgaacccgggaggtggagcttgcagtgagccgagatcacgccactgcactccagcctgggcaacagagcaagactccgtctcaaaaaaaaaaaaaaggtttatttggctcataattctggatgaccagaaagttgaagattgggtatctgcatctggtgagagcctcacgctgcttccactcatggtagaaggggaagaggcactatgtgtgtagagatcacatggccagagagtgagggtggaagtgccaggctttttttttttttttaaactagctttggtgggaactccctcacccctgctccccacaggaaggcattaatctatttatgagggatctacctgctataacccaaacaccccaccagcccccatctcccaacaccaccacactggggattaaatttcaatgtgggatttggagaggacaaatatccaaaccatagcagtcttaaagtatttaaattagaatttaaattaaaatttaaattacagtatttaaattagaatcatttgtggagtttctaaaaggtatgcattcctaggcccctctcaagttagatttatgaacactgatccccagtctgaattttaaaacagcaaaatctcatactggttctacagattattctgatgcacaatctgggttaagaaccactgtcctgtagtcgtgaagtctatatattttggtattttctttacctcttctctaattaaccagtctgaaggagtttgaattttggggatcgtacattgtctgcaagagaaacacattaacatccgtgcacatagagtcctttgtaata

SEQ ID NO: 99840 - DNA, 377 bp, Homo sapiens
gctctgtcatttccgaagagtgaccttcctggcctcctcactgtccaatctgcccctactcttctctgtcataacactgtctcgttttcctctgtagccctttttatgatttgtaactggacatttgttgatgttcacatttgttcaatacatcctcccagctaaattctgaacgtcaggaagatattccatgtctgcttcatcctggcagataggaaggactccagaatcatttaagtaatcttttataaaaagaggattatttttccagtttcttctttgactcagtacaaacagaatttttttaaattattttgctgcttcactccccatcttaactacaaaagtttaacctcaaaaaatgtttaacaagttca

SEQ ID NO: 99841 - DNA, 208 bp, Homo sapiens
ccaggtggagagatcctcctggagaaccaagccagaagggaggagaacagagtcaagagctagagatcaagttttgttggccatctgggggtacctgcattcaactgtggttgaagaaaagtgcaaatcctgggttatcttctaacataaacctagaccaaaccagaaggaaaccacaacagaacaaataaacagaacattcttactc

SEQ ID NO: 99842 - DNA, 582 bp, Homo sapiens
cagtctccaatgtaatgccctgtaatagaagctgtccttaaccctcaatcatctgtattcagctagtataaaaatgcaaatctgctcttatgcctaaacagttaggagtagaggagacttggcttcctttggaaagtcaggatgatagcttcatcccattctggtttttgtgattaattgtgacctacaaaggggtttactactctagcaggaactttgaatttcctatatacatctctttctggttagcaggcagaggaaatatcgttgacttttggcttcctggcaaatgtctcatttgccttgtcatttgttgattccttttccctgatctctgtttggtgtgataatgtacagcaaagctgaaaaccgcagggctacatgtacacttgtaggtacctatgttgtgattgccaaaaggctcagaaagccagttttctagtgaaaatggctaacattctaagaaatgctttcactgagaaagagaacgggtcaggggaaggtggaacttaaaggaagatggagtgttcctgaattcagattcctgaattagccatttatagtttcatgggaagacaatga

SEQ ID NO: 99843 - DNA, 204 bp, Homo sapiens
atgggggtgtcctggaagtgcatgtttctctttgctttgctttgcttttttgagacagaatgtccctctggtctcagctcactgccatttccacttcccgggttcaagtgattctcttgcctcagcctcccaagctgggattacaggtgtgtgccaccatgcctggccaatttttttatttttagtagagatggggttttgctg

SEQ ID NO: 99844 - DNA, 430 bp, Homo sapiens
gattcttcctaaaggtttcagccacagcccaggccctgagacgcctcacctgatcttctctgatggccaggcctgcattatgcatcccctctaggagtgggaatcgggtcaacccacataagtcatatgaaccaaggatggggaaaatgtaggctgggagcagtggctcatgcctgtaatcccagcactttgggaagccgaggcggtagaattgcctgaggtcagcagtttgagaccaggctggccaagatggcagaaaccccctctctactaaaatacaaaaattagccgggcctggtggcgggcgcctgtagtctgacttactcagaggctgaggcagaagaattgcttgaaaccaggagatggaggttgcagtgatccaagatcgtgccactgcactccagcctgggtgtcaaagtgactctgtctc

SEQ ID NO: 99845 - DNA, 986 bp, Homo sapiens
taacatttaggttcgggggtacatgtgaaggtttgttacacaggtaaactggtgtcacggtggggggtttgttgtatagattacttgactagctcaagggtagagcatttgacacctttattgttattgttcgtttgttctgcaacccaattcagctgccattacaccactaattgaaaccacccttgttaaaatcactggtgacttcatgaatgtcaaatccagtatttacatttttttctgcatttatgctgaaatataaagtatatagtaatgtgcattaaacttatatgtgcaatttaacaaatagctatcaagtgaacactcacattattaccacttagatcaagaaatagaacattttcttggcccagatgcagcccgcaccacagctgcattcctcacccagggggagtaatcactattgggtggcagtgctgattatttacttgctttgctttacggtcatgttttgttttgtcatcaccagggtcaaggtaatgaacatattcaccaccccaaaggtttccttctgcctcttatatcctactcaccactccctaccccagccccaaccaaacaaccactgatctgctttctgtcactacagattagcccatattttctagagtattatattaacaaaatcatatggtcttttcttttggtctggcttctttcactcagcacaattatttgaagattcatttatgctgtagcatatatcaataattcatcagtttttattgctgagaagtgtagcattgtgtggatatatcacaatttctttatccttcaccagttgatggacattagggttgtttccagtgtgggactattacaaataaagctattgtgaacgtttgaaaatatgtctttggatatacacattcatttctcttgagtaaataccggtaaaaacatttagaagctgagtaaggcctgcagtctagttcacagtagtgtaccaatgtcagtttcctggt

SEQ ID NO: 99846 - DNA, 256 bp, Homo sapiens
gctttcccattagtttctcgtttggttgaataaatgaatatatgtatgaatccatctatctaaccaataattacctggtgtgcattatgggtcaggcactatactagaggtagatgcaaggaatacaaaggtgaagaagaaaagcacggtctgtgtactcacacacaatttataatctagtgagttaacaatccattataatacaatgtgacaagacttacgaaaaaggatgccaaaaaaggctctatgagcacta

SEQ ID NO: 99847 - DNA, 394 bp, Homo sapiens
tttggtctgagataggctaggtgtggccaggagcatgtggggtagggacccagaagtggagaaggggtgctggggtcccactgtccctgcaaacctgcagccagtgaggctatcttcaggcaaaggtattttgaccctagaaaagccagtccctttcctgaagccaaagacttttctgagagttcagttaaagagtgttaaatgttttgatactgtttttatcaggtactgtgacctcattagttggagtcagttttagtattctcaagatttggtgttttaaaaaaggaaaataaaagacagaaaatgcccccaaaatgatcaaagggaacaaggttgaaggagccatcttcttgaagaacagcctgctcccgaaatacagccgccactggcc

SEQ ID NO: 99848 - DNA, 628 bp, Homo sapiens
atagcataattattcatacgcattctccttttttcaaaatggtcctagattaaatgaaaatgacatggtcactgggcctggtccccagataccctgaatcttaatttatctcccattattttagagttcttattagggagaccctaagttcatatgcaggctcaacctgcatataagaagttgtttttgttgttattattgtttttaattttctgattaaggaaaatataggggtataattacactacccatttcttatatgtcttataagctactcaatggtaaggaaaatatttctatagtctagtaacccttattgtccttctttcaaagaagaaaacatctcttgtcccattctgccaaagccagtgtgtgtgtttgtgtgtgtgtgtgtgtgtgtttaatgctgagtttttcacacataatcatagtgttatgaaatttggctctgccgagtaatggctgagttaaggtgtagccaaggcagagggtcgtttcagtaaatggaagagcaggtcactgaagaagatcctaagtgttgaatagacaagggactgtcttgggatgatgaagaacttcaggatagaggaaaatcagaagtctggtatcaacatctttaggaaatgag

SEQ ID NO: 99849 - DNA, 1050 bp, Homo sapiens
  misc_feature (942)..(942): n is a, c, g, or t
  misc_feature (964)..(964): n is a, c, g, or t
  misc_feature (988)..(988): n is a, c, g, or t
  misc_feature (1012)..(1012): n is a, c, g, or t
  misc_feature (1019)..(1019): n is a, c, g, or t
  misc_feature (1025)..(1025): n is a, c, g, or t
  misc_feature (1035)..(1035): n is a, c, g, or t
gcaccggttccccctgtttctttgaaatgcacttaagctgactttatttcccaatgccccttcttattgctatcacatactgaggcccagcccacccagttcctctccctcatgcagtaataactttaatagcttgtttattgtttttatttctaattcagtgtctgtcaccatcttggagatttaaacacccagtgacaccttcaacactttggcctttcagttggctgacccccttagctacaaaaatctcttcctctatattcccttggtcctattctagatattatcactataggttgaacaaccaacattcaaaaatctgaacttcacaatatgaaagttcatattttgaacttcacccttcaaaatatgaaactttttgagtgcctacgtgcagcctaaatcagatttgggattttcagatttgggatgctcagccagtaaggttaatgcaaatattccataatttcttttaaaaattcaaactctgaaacacttctagttccatgaataagggatactcaacctgtaccaacaactatactttcttcaaaacctaagcttcaaactgtcttttcttacatttattctattggcagaactttacttctaaacacactccagctctatcggtaatatttctctccacctccactactgtcaccctggcatgactcacttcctcctgcggtacttcaggggtctctttccagtctccctgctgtagtccacttggaaaccctgcatggcataggacaagagttcaacagagagttgtggaattaatgagtgatttacgcacgttgagaagatagggagtttgggatctgtgcatttaatacagatgttcatgggaatgtccaaggagtaaaaatttgaggaagggaaatttgaaagagttttcaggccagatatatctataggaaattcattagcatnaaatatggatagttgaggacanaagaatggggtaagggtcatttantggaaaaagtttaaggaccaggangcctganaactcntattggaggnctaagtaagggctaa

SEQ ID NO: 99850 - DNA, 456 bp, Homo sapiens
gtagcaggatcagtatgaagataatacagtatctcttaaaacaggcagccagcaaatgaactttctgcattggtcagaatttccatcatttcactgttaatgaggaaagtacagttctttagctaccatgaaagtcaaacatatcctaagccttttggaaaaagacatacatgttagaaaatctcaaatggatgagtcagcctgactgaccccacattgactccattttatatgctggccaaatcctgtttctgactttcctggcacagccctggacatgcttctgtatcataggacttgttccccagcgcctttgctacttccttcaggcacattcctaggaaagattggcagtggggtttgctctttgccagcactcctgccggtttgggggttatggatgccaggttgggctccaggcactctgctctccatttgtggaggcagggacggtaa

SEQ ID NO: 99851 - DNA, 430 bp, Homo sapiens
tttctctaatggatttaaatgtcatatttatgccgatggccctccaatttatatctctgtggcccaaacctcttctctgagtataccagacttgaagagtcaattatctccttttggttgccatacagagttctcaaacttagtgtgtctgaaatggaatttcattttgcctctccagcctttattctcctttttagtaaataacatcatcatctatctagatgctcaggccagaaacataggagtcagccaggattcattccttgaataaagaataaccaaaccataaacaagtcctttgatttaatctctaatatgtctccatttgacctctctcggcgccttctgctgccatccttctccacacacagctgtgaactatctagacactgcactggcgttctgactggttgtgtctgactatgtctca

SEQ ID NO: 99852 - DNA, 419 bp, Homo sapiens
agacatttgtcaaggcattgagggtacagtagcaaataagagaaattccttttcttcaaaacattcacagtccagtgggagaaacagacaagtaagtggaaataacaatgcaatgtgaggatgataataatattatcattttaaggtgctatcaattgtagcatgcactgttatgtactatcaagaaaaaatatactgccattaaactgaattataatgccttaacgatagtctcacgtgacacatgaaccagatacaccaacctctgcttactttgaaatcgtttattagctattccaagggatttcacaatttctctggcccttggttgctttgcttggtatgtgacaggccatcttttcagacatatctcagtaacaaaacatagcacaacttcatctgtttatatcttcgtttcc

SEQ ID NO: 99853 - DNA, 658 bp, Homo sapiens
agcagttactaaaatagtaggccagtgtaaggatatgttgactcttggatactgctacaccctatggctgacttgcatttgctatttacacctgtggttctcaggctgaaagccaggactcttgtaataaactgccacttctgaagagggagactaagatgtctgttaagataggaaaagagaaagaaaataacatttgtactctgcacagttttatctaataaattggcataagttggtcagtctgttattcactgtgaattccttaactgcccttgatgtaatttaattctaatcagttataacacaccaggaaagaaattgcttagacatgcaatctttcttagagcaacatattatcttcaaaaggagaattcctctttgaattttgaagcacctgtggcctcagggcaaagtgatgactacttaacccaaggaaaagtgtccctctgggactttgacatgtttctctggagcgcaaggtcattttcaaacatcctaccagaaattgcagaggaagacacttacattttgaaggcgtagagtctcatttaggccagtgttattctattttgattaatgaagcagtgagctatttcctaaagaatatggcaacaattgtgaagaattcatttaccatcagaaggtgaaggaattg

SEQ ID NO: 99854 - DNA, 689 bp, Homo sapiens
tgagacctcatctctacaaaataaaaataagaaaaattagttgggcatgatggcgtgcacctgtagtcctagctactcaggagtctgaggtgggaggctcgcttgagcccaggaatttgaggacatatataggggggattggaggaaactttgggtggtgatggatatttctgtggccttcatggtggtgatggattcatggctgtaaacttactcctaaactcatcaagtgtatacatgtatgtgcagctttttacatgttagtcatacccctaataagagtggctttatatctatgtctatctatctagtctctctgagaacttattatagtcagcatttttagacttacccaggtattgtcaccttctctgcccttactccttcttgtgtttctggtcttttatcaagagtcactctccctgaatttaattaattactttttttgtacaattgccttccccaaagtgtcactttctttctgcctgaagaatacccttagaatttgaatgtgtatttgaagatggtattctgtcagtttttgcttgtctgagaatcagttgtttttgcctcagttcttgaagaatatccccacaggacagagttctaggttgacagttattttcttgagcacagtgaagattctactccattgtttcctggcttccatctttgctgttgagaagtca

SEQ ID NO: 99855 - DNA, 699 bp, Homo sapiens
cacttaggaatttttctgattcggtctaggtgtatagaagtgaagatgtagcttatttcccaatatctgttcattgaaataatgtctcagtgtaaattttattgtgtagaactaacagttgtggggattaaattgcccttgtcccttaaagttattcatagtatcaaataattgggaaatgtttttggaaggaaagaaataggggaatagccaaaaaacagttcccaggacccttttaccataaggctacagcttcttgctggaacattaacctgcgtaattatgaagtagtagtagaatacagatcgctttattgatagaaaaagtgaattataaaaattccctggaagtttgtttaaaagactttattttttagccttacacttgaaatgtggtttcttttaaaactaggctgttggccagtataggacaaaaaacagactcctacttcaatattcagataggaagtgaaatttaaaattaattgacattttgtttaatgttagttagctcatataactcacggtacattaatgcacttcactctaattgttaagacttcacttttgttttgtaacaagtgattgctccgatttgtgtactttattccattccagtagaggtcactgtgcctctttaatcatctaagatgaaatttgatataaagatagatgaaaccgtgaggaaagaatgctagaa

SEQ ID NO: 99856 - DNA, 722 bp, Homo sapiens
gtcggcgcgggaggctcaaatggctggaggcggcgggcacgcacactgcgggctccgaggggcacaggtccaggctcctgcgtgaagtgatgctcctctttgccttactcctagccatggagctcccattggtggcagccagtgccaccatgcgcgctcagtggacttacagtttgagatgccatgactgtgcggtcataaatgacttcaactgtcccaacattagagtatgtccgtatcatattaggcgctgtatgacaatctccattcgcataaattctcgtgaactacttgtttataagaactgtacaaacaactgcacatttgtatatgcagctgaacagcctcctgaagccccaggaaaaatcttcaaaactaatagcttctactgggtttgttgttgtaatagcatggtttgcaatgcaggaggacctactaatcttgaaagggacatgttacccgatgaagtaactgaggaggagcttccagaaggaactgtgaggctgggggtatcaaaactgttgctgagttttgcctctatcatagtcagcaatatattgccatgaggaccccaccttggagggtctgaccatcttcacctgttccgcagagaaatgttgctctccattattcccttctaagccagagacccttatccactgctcctctaggtggcccatttatggtttgttgtaagagaaaaattaaaaaaatattgttta

SEQ ID NO: 99857 - DNA, 312 bp, Homo sapiens
ctgtggtttgggagaactgtgggaaaaagccagaatgatagaagttggtaggtagaaacaggaatgttataatttatcttttcaaaggccaggtgcggtggctcacgcctgtaatcccagcactttcggagaccgaggcaggcagatcatgaggtcaagagatcaagaccatcctggctaacagggtgaaaccccgtctctactaaaaatacaaaaaaaatagctgggcgtggtggcgggtacctgtagtcccagctactcgggaggccgaggcaggagaatggcgtgaacccgggaggcaaagcttgcagc

SEQ ID NO: 99858 - DNA, 385 bp, Homo sapiens
tcacttgtttgtttggttcccccatgagatcagaaattcagtaagaataggcattgctgtgtctccagcataaaacagaacctggacttgcaagcactaaataaaggttaggggaatgaatcaagaaccccggggtgtgtgtgctgtttttcccctttgcagatgaggagagacagctcagagtgcttaagtaccttgctcaggaaacacagctggtaggtgacatttaacagagacctgagtgaaggtcagaagtgagcattccagccagaagaaactgtatgtgcaaaggtcctggggccagagaatgtctgatgtgttcaatgagcaggaaggagccagaatcagtgaaaaaggtggacaagggggcagtgatgggttgcag

SEQ ID NO: 99859 - DNA, 452 bp, Homo sapiens
  misc_feature (280)..(280): n is a, c, g, or t
tctcttttactacatgtatccgaacaatttcctgttaactaatgttttgacttttggttttagtatattttagtacaaaagtccaggaacaagttcttcagttggatctatctgagatgctgattgttcaactgatgaacaaaaccaccatgtgctctactaaaatatgagtgtctgtttcttgtagtccttgtaatttagttttatcctatctgtgcatatataaaattagtttcatttatcactatgagacaaatgataaaaatattttcccggccgngcgtgctggtgtgcacctgtattcccagctactccagaggccaaggtgggaggatcacttgagcccaggaggtcgaggctgcagtgaggcgagattgtgccactgcactacagcctgagcgacagagtgagaccctgtctcaaaaaaaaaatcggttttcataaaaaaaaaa

SEQ ID NO: 99860 - DNA, 230 bp, Homo sapiens
tagaaattgacttaaagacaatcaattctgtttgtattttctgccctttgatcatttggaatggtctcttataggaggaagggggcagattgaaaaacaaatataaaaacacagtcactgaagatgtggccagtggaagaccttgcagagctgtgttgttacagaacacactccttcaacctagcatggttcttttccagtagctcttaaccatgatttccaagttgtag

SEQ ID NO: 99861 - DNA, 460 bp, Homo sapiens
  misc_feature (288)..(288): n is a, c, g, or t
gaagctggttcccaggcctgcctctaccctaccccagcactggttggaggctgggtctgttccagggctagggggtataggaggcctattagtccaccttctctggcagctttgacaaatagtcacttctataccttggaatggaggaagaaggcccaagtggtggtgagccagggcagggtaaagaatttgcttgtttctgccaggcacggtggtcacacctgtaatcccagcactttgggaggtcaaggcgggtggatcacctgaggccaggagttcgagaccagncctggccaacatggcgaaaccccgtctctactaaaaatacaaaaataaattagccaggggtgatggcgggcgcctgtaatcccagctactcaggaggctgaggcaggagaatctcttgaacccgggaggcggaggttgcagtgagctgagattgtgccactgcaggccagcc

SEQ ID NO: 99862 - DNA, 314 bp, Homo sapiens
atgaggggtctgttatcagctgaccggtgtccctaaaaggatactgtgaagtcctgagccccgcaacctgggaatgggactctgattggacacgagtttcttgcagatgtgattatactcaagaggaagccattagggtgagccctgatttgatgacaagcatcctcataagaagaggaaaacacggacacagagacacaagcagatggttccaggacagatgcagaggccagagggacgtggtcacagccacggatagcaggagcccccagaagctgggagaggcaggaagggtcctcccctggagcctcgag

SEQ ID NO: 99863 - DNA, 962 bp, Homo sapiens
aaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatattttaaaaaaattagagtgaagaaaaatgatgaacatattgtaatgatgcttctgtgaatttgaataaaaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaa

SEQ ID NO: 99864 - DNA, 550 bp, Homo sapiens
aaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtggcgggtgcctgtagtcccaggtacttgggaggctgaggcaggagaatggcgtgaacccaggaggcggagcttgcagtgagccgagatcatgcgactgcactcgagcctgggtgacagtgcgagactctgtctcaa

SEQ ID NO: 99865 - DNA, 301 bp, Homo sapiens
acgaatcgagctcggacgggattcgctagagtcgagagcaggctctgcagcgtagggactggccgtcgtagatatcgtatgtgtggggtttttcttattatgataaatatctgtttacaagcattttaatatttaccaaattacttttttcaagacacatttcttaaaatggaaatcttccgtggccgggcgcagtggctcatgcctgtaatcccagcactttgggaggccgaggcgggtggatcacgaggttaggagatcaagatcatcctggctaacacggtgaaaccccatctctact

SEQ ID NO: 99866 - DNA, 946 bp, Homo sapiens
cttcccagttcatgattctctaaatttttgctcccatggagcacatatctctaacaattcaacatttattgagctagaaattgtgtgctaagttctaggaatatagaaataataatcagaatccctgacctcaagattatggaaaagaaaagaaaataatcttgtaattataacaaagagaaagaactgcttgcaattgcatgtataactgcaatagtgatacgagggcaatgcagaggcaagccttacactagctcaatgcccaacccaccacatcagaactaactactcatttacctgtcaggctcctctatcagatgatggacccagaggactgacagtatcttatattcccagtttccagtctagaaactggtacataaaacagacctaataaatatgccatggttcctaaggttttactaattgaattagcatggaagttagcaaatattagaatatttgaacaccagaatgaataaacaaacaaacaaataaataaatttctgtgcttgtctttgcagattggctctgttttggggcactcctttaatgcctagacaggctaccactctgccttagccttgactttcttcttgtaagcagcataaatagccatagataaaatcttgttacataaactaattatttcaatctataaaatcaatggaacttaaacaagcgttccaggcaagggaagaacagctcctggtgagtccttaggccactgagtaagcccagactccctaccaaaaggaactgagctttaacattctagacagaaaacctccaagagaagggatggagatatgtccattcactcagtaaatattcatgggatgcttactatgtgccaggtgctgttcaagaatgttcacaatagtagacaaaacagacaaaaatctttgtctccatggagattacattctagtggagaggtgagaaa

SEQ ID NO: 99867 - DNA, 1352 bp, Homo sapiens
ggcagggccctatgatttatgcaggagcagaggcagcacgcaatcgagctgtcaagagagcgtcacttattaggcaaatgctgcgtggtttttgaagagggtcgacactataaaatcccactccaggctctggagtggagaaactcagagaccaagtccattgagagactgaggggaaagagaggagagaaagaaaaagagagtgggaacagtaaagagaaaggaagacaacctccagagaaagcccccggagacgtctctctgcagagaggcggcagcacccggctcacctgcgaagcgcctgggaagcgagtgcccctaacatgcggctgccgctgcttgtgtccgcgggagtcctgctggtggctctcctgccctgcccgccatgcagggcgctcctgagccgcgggccggtcccgggagctcggcaggcgccgcagcaccctcagcccttggatttcttccagccgccgccgcagtccgagcagccccagcagccgcaggctcggccggtcctgctccgcatgggagaggagtacttcctccgcctggggaacctcaacaagagcccggccgctcccctttcgcccgcctcctcgctcctcgccggaggcagcggcagccgcccttcgccggaacaggcgaccgccaactttttccgcgtgttgctgcagcagctgctgctgcctcggcgctcgctcgacagccccgcggctctcgcggagcgcggcgctaggaatgccctcggcggccaccaggaggcaccggagagagaaaggcggtccgaggagcctcccatctccctggatctcaccttccacctcctccgggaagtcttggaaatggccagggccgagcagttagcacagcaagctcacagcaacaggaaactcatggagattattgggaaataaaacggtgcgtttggccaaaaagaatctgcatttagcacaaaaaaaatttaaaaaaatacagtattctgtaccatagcgctgctcttatgccatttgtttatttttatatagcttgaaacatagagggagagagggagagagcctataccccttacttagcatgcacaaagtgtattcacgtgcagcagcaacacaatgttattcgttttgtctacgtttagtttccgtttccaggtgtttatagtggtgttttaaagagaatgtagacctgtgagaaaacgttttgtttgaaaaagcagacagaagtcactcaattgtttttgttgtggtctgagccaaagagaatgccattctcttgggtgggtaagactaaatctgtaagctctttgaaacaactttctcttgtaaacgtttcagtaataaaacatctttccagtc

SEQ ID NO: 99868 - DNA, 928 bp, Homo sapiens
aaaaatcggcacgagggggatagatgaacttgatttagagagcctataccccttacttagcatgcacaaagtgtattcacgtgcagcagcaacacaatgttattcgttttgtctacgtttagtttccgtttccaggtgtttatagtggtgttttaaagagaatgtagacctgtgagaaaacgttttgtttgaaaaagcagacagaagtcactcaattgtttttgttgtggtctgagccaaagagaatgccattctcttgggtgggtaagactaaatctgtaagctctttgaaacaactttctcttgtaaacgtttcagtaataaaacatctttccagtccttggtcagtttggttgtgtaagagaatgttgaatacttatatttttaataaaagttgcaaagggttaaaacaacaacaacacaacacaacaacaaacaaacacaacaaacacaacacacacaacaagaacagaacaacaacaacaaacaacaaaaaagacaaaacaacaacacacgaagcgacgaccgacgcaaccaagaggaccaccgcgacacaacaaccaccacccaccgcgcgcgcgcgacaagtctggggacagcgagacggcggggacaccacaacgagggagaacacagcggagctgccgtgcgggcgacaagaggggcggagcacaaccgcaagcaacacccgccgccgtgagagacgaaaaggcacagacagcggggggggagcgcgacaccctacaccagacaggaccgagatggacaaaaaaacaacccccgcgcggggggggcaagcaccgaacggagcgagcggctcccaaagagaggacgaagaccaacccctcacagagggggggcaggcctacgaacacgaggaggaacagcacgagggagagcgatcacaacaacacgaaccggcggcagc

SEQ ID NO: 99869 - DNA, 1941 bp, Homo sapiens
ggcagggccctatgatttatgcaggagcagaggcagcacgcaatcgagctgtcaagagagcgtcacttattaggcaaatgctgcgtggtttttgaagagggtcgacactataaaatcccactccaggctctggagtggagaaactcagagaccaagtccattgagagactgaggggaaagagaggagagaaagaaaaagagagtgggaacagtaaagagaaaggaagacaacctccagagaaagcccccggagacgtctctctgcagagaggcggcagcacccggctcacctgcgaagcgcctgggaagcgagtgcccctaacatgcggctgccgctgcttgtgtccgcgggagtcctgctggtggctctcctgccctgcccgccatgcagggcgctcctgagccgcgggccggtcccgggagctcggcaggcgccgcagcaccctcagcccttggatttcttccagccgccgccgcagtccgagcagccccagcagccgcaggctcggccggtcctgctccgcatgggagaggagtacttcctccgcctggggaacctcaacaagagcccggccgctcccctttcgcccgcctcctcgctcctcgccggaggcagcggcagccgcccttcgccggaacaggcgaccgccaactttttccgcgtgttgctgcagcagctgctgctgcctcggcgctcgctcgacagccccgcggctctcgcggagcgcggcgctaggaatgccctcggcggccaccaggaggcaccggagagagaaaggcggtccgaggagcctcccatctccctggatctcaccttccacctcctccgggaagtcttggaaatggccagggccgagcagttagcacagcaagctcacagcaacaggaaactcatggagattattgggaaataaaacggtgcgtttggccaaaaagaatctgcatttagcacaaaaaaaatttaaaaaaatacagtattctgtaccatagcgctgctcttatgccatttgtttatttttatatagcttgaaacatagagggagagagggagagagcctataccccttacttagcatgcacaaagtgtattcacgtgcagcagcaacacaatgttattcgttttgtctacgtttagtttccgtttccaggtgtttatagtggtgttttaaagagaatgtagacctgtgagaaaacgttttgtttgaaaaagcagacagaagtcactcaattgtttttgttgtggtctgagccaaagagaatgccattctcttgggtgggtaagactaaatctgtaagctctttgaaacaactttctcttgtaaacgtttcagtaataaaacatctttccagtccttggtcagtttggttgtgtaagagaatgttgaatacttatatttttaataaaagttgcaaagggttaaaacaacaacaacacaacacaacaacaaacaaacacaacaaacacaacacacacaacaagaacagaacaacaacaacaaacaacaaaaaagacaaaacaacaacacacgaagcgacgaccgacgcaaccaagaggaccaccgcgacacaacaaccaccacccaccgcgcgcgcgcgacaagtctggggacagcgagacggcggggacaccacaacgagggagaacacagcggagctgccgtgcgggcgacaagaggggcggagcacaaccgcaagcaacacccgccgccgtgagagacgaaaaggcacagacagcggggggggagcgcgacaccctacaccagacaggaccgagatggacaaaaaaacaacccccgcgcggggggggcaagcaccgaacggagcgagcggctcccaaagagaggacgaagaccaacccctcacagagggggggcaggcctacgaacacgaggaggaacagcacgagggagagcgatcacaacaacacgaaccggcggcagc

SEQ ID NO: 99870 - DNA, 289 bp, Homo sapiens
attgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtc

SEQ ID NO: 99871 - DNA, 99 bp, Homo sapiens
aaggaaagaagtaaaactgtctttattcttcatgacatgattatccatgtggaaaataggatggattctacaaaaaggctactgtaatgatataagatc

SEQ ID NO: 99872 - DNA, 866 bp, Homo sapiens
accccctcaacgctttatattccaccctcgtgtgtgaagtggaggtgcaggtggcattaggaatgaggatgtgacactgtaaagttaggagatgatttcttcccccccccccttttttttttttgagaccagggtcttgctctgtcacccaggctggaatgcagtggcacagtcaaagcttactgcagcctcaacttattgggctcacatgagcctcccacctcaccctcctgagtagctgggactacaggtgtgtgccaccacgcccagctaattttttattttttgtggagacaaggtcttgctttgttgccctggctgttctcaaactcctgggctcaagcagtcctcctgccctggcctctcaaagtgctgggattacaggcatgagccattgtgcccagtggagatgatttctcccgtaagttttttagttaaggaaaggagagtgctctgctcacttgaattttgtgggcctttttttgttacgatactcaaggataaaccatatttagttcctgctatgtttaggttattaaaataacccatttcttcttcatgtgtttagtaggagaagacatggaatgaagatagaattaatacaattgtggtttcttttctagggtttatctcctttacctgggccatttccgagatctctttcatttcctgctcccattgcctgcaatctgcagaacatttaaataaagggctctgatttcctcagttagtaattattggtaaaggaatttgagttccttttaatataaatagagggataactttcctgaataatcactaatatatggtgtcccaaaagtcttagtgtagttttaagctataatttctgaagtatatatgctaca

SEQ ID NO: 99873 - DNA, 495 bp, Homo sapiens
gtgaattcctgtgatagtgtgttattaggattatatatatatttttaagatggctgccacgaagtgaaagtcaaagaaatatcaaaagtacgcctggtacctcttgagtgtttttgcattgtaggtggaataggaacattgttatgatacacatggacaatgttccctagtcatttctattccagtggcaactatgtttgtaacaccattgactataagggtaccagagctggacccaaaaaatgtgagctgaaagggtggggtcaaagacaaggaacatgaaagaaagaagttagaagctagaggagaatgggaaaattgtgtgcagtctgacgtaacagtggtcactctgttaaaataagcttatttccttgataaagtcattggcaacacctggaattatgcaattttatttgcagggtgatttccaaatagttggtgccctacccaaataaatgtctcttggaaactcgagttagaatgagggctgagcta

SEQ ID NO: 99874 - DNA, 485 bp, Homo sapiens
tctctgaggttcatagggctctgaggacagtagttatcttgagtgaagcacaggctccttagagcaacagggtccttttaagtattagtactctgccatcaaaggtcatctgtgtgaaagaatgccaaatgcacaagataccctcccctcagggctgtctttccagaaatcaaagcaggatgttacaatctgagggccacacaacctcttctgtaagtggcttgctgtagtctctttctattattttattctctctcctttcaggagggcccttcaaaatcccacagtgcttaatctaactatctccctctgagggctctttttgcagtggaaaagcatctgaggtcattggagtgaagccttgctcttggagggaaaggaaccatgcctttgggagggatgtgtctgtttcctgccaagacttgtaggaaagcctgtcaatagagagacaccagaggagaaaaaaactgcaaactgtctgttac

SEQ ID NO: 99875 - DNA, 203 bp, Homo sapiens
gaacgggtgatgcggttgggggaggaggcggagccggctgaccgcagccaggagtcagcaccctggagggcggcccctcggccgcaggcagcggtggcagcgggacctcaacccagaacctgagccagaatcggaagagccagacggaggctttaggacgctgtatgcagagctgcgcagggagaacgagcggcttcgcgagg

SEQ ID NO: 99876 - DNA, 733 bp, Homo sapiens
ggccagtcacagggctcaccagtccctttggcggagtctctgcctcaattcttgacttgtaataatgtaatgatggctatcagggttggaacagcaagcacgataccagcactttaggaagattagtttcctctatttaatgctcatgactacctgcaagggaactccagtaccattgtgggaggaagattcacacagacggaagttaatgaataatgtgaagaaatgtcacacatgtccagtgagaagaaatgatgtgtgctacaggacttcaactgaggaagggatgcctgcgtggtcagaggaggctcatggaaaaggtcagaaatcacagagaccttcaacaggaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagag

SEQ ID NO: 99877 - DNA, 271 bp, Homo sapiens
tggaagataatgttttctaggttaaagcctttcctgctcctctctaggcaaatagattttggtttcttctgcccacgagagggttgcagaaactcatattcctgggcaatgaggccaggtgacccctaggaacacagtcttcattgcctcaaactggccttcctccctagtctagctgtcagccgtcatcacgctaccaccatgccacagtgggatcagcattattctcattggtcttctacccaggctgacattgttgaaagaaaccttg

SEQ ID NO: 99878 - DNA, 762 bp, Homo sapiens
caggctggagtgcaatggtgtgatctctgctcactgcaacctccacccccaggattcaagcgattctcctgcctcagcctccagagtagctgggattacatgcgtgcgccactacgctcagctaatttttgtatttttagtatagacggggtttcaccatgttggtcaggctggtctcgaacttctgacttcatgatccgcccgccttggcctcgcaaagtgctgggataacaggtgtgagccaccgcgcccagcccaactgttaatgattattttgggggagtaggtcagcaataataaaatcattatgatccacatctaacccacttaaaaaatttctagattctcagtttctgtttaattgcctatcttctggccagttcaacctgcattaattactacagcaatacagtatgtcttgacagctaacagaactagtttcttcactttatttttcatcttaaaaattatcttgcttatcctttcatccttaatttccatatgaattttaaaaccaggttgctgcaatccacacaagtaaaaacacttggcattttttggaattttgttaaaattacagactaatttgaggagaatgtcaactttaaaagagggtatctcaacagcagcgttactgatattttgggctaatttttttttgtcatgaggggggctgtcctgtgcactgtaggatgctcagcagcaccctgatttctaattaatagacactaatataaacaaccttcctctctgtgtgatgac

SEQ ID NO: 99879 - DNA, 206 bp, Homo sapiens
gtcagtgaaagggaaatgcaaaataaaggaaagcaactggtcatctttgaattcccatataagctttaaatctcattctggtcagtaaaaatatcattagttgttttaccctaaaaatttttattttttttattttttagacatagtctccctctgtcacctaggctggagtgacctggccggaaagaggaattttaattgctaca

SEQ ID NO: 99880 - DNA, 145 bp, Homo sapiens
atcttttactctagggcacagcaggcaaactatgtacctgtgggtaaaatctggcctgctgcctagttttccaaggtctatgagctaagaatggttttcatgtaaatggctaaaagaaattcaaaataagaatattttgtgacaa

SEQ ID NO: 99881 - DNA, 175 bp, Homo sapiens
taattgtaggacaattgtgtcattatttgaaagcttcaggacacagaattttcagtgcatcagaagcacttttttgttagaggaataagcattgttagcatatgcagtaccagtttgccttttcttattctgattcaatttagggcatttaatttattagcacctgccagagtag

SEQ ID NO: 99882 - DNA, 424 bp, Homo sapiens
cccctgccttggatatataatgatgaactccaactttaaaagtccaaatttgatgccctgggtttacccactgatgcctgtttccccccaagccttccccaccccagtcatggacactccaagctctggtggctcagcccaaaagcctagagtcaccctgggctcctcctcctctcacatccacatctgatccatcaggaaatcctgactcctctatctttaaaatattttcagtttccaaattcctcttatgccatccactgctactgccctggtccaagccaccaactctcacctgaactgttgcagtagctccctaagtgtctccctggtcccacccctgccccctgtagtccaccctcagatcctttcagcaaccaaggcaggtgagtgtcctctgctccagacctccagtagcctccca

SEQ ID NO: 99883 - DNA, 450 bp, Homo sapiens
agccaatggaaaacagaagaaatcaggtgttacactcccagtttcgacaaaacgtatataccaataaagataaaaaaagacagagaaggacattacaaaggtggtcctgacctttgataaatctcgttattgattgataccaacctgggctatctttattgcccaaaccaacaggataatttgctgaggttgtggagcttctcccctgcaaagagtccctgatctcccaaaatctggttgagatctaagtttgattttgctgtacaactccttttctgaagttttactcatttccaacaaggaaggcaagttttcctgcttctgtggtgatggagagcaggcacctcctttcctgagtttcagcttgcctctgacagggaaggtgagtgtaagttgtttccagcttctaagatggcagagaacgatccccagcctgagccttgtttccag

SEQ ID NO: 99884 - DNA, 782 bp, Homo sapiens
ggaagggagagggagagggagagggagagggagagacagagagagagagagaggaaagagttgcctgtgtcttcttattcactttcttaatcatgtcttattataaatagatgttcttaattttaatgaaggcccatctacttaggtatgtccacaataaatgggctgggttatgaaatttataagagggcttaagaaatttggctcaggatcacagctagcttctgtgtgttgtgcaacacattctgatcttccagtgtttcaggccataacctacacaacttcactagtgcctgggaatgttcaaggccttggcttgggttcaaacctgcagggaaaacatgcagctgaacaggtcacagagagatcaaggcgctctgtgaaacatagagagcgagggaaacttggggaacctacaaacctatcatcatgagaatgaataaaaaattgtggtgtggtcatataaaggaagattatataacaattgaaaaaaagccctgttgatttccaaaacaacatgggtgaattccagaagtaccagtttggatgaaaaaagagagatacaagagattccatttatatgaagttcaagaacacgcaaatcttatcttgagtgacaggagtcagaatagcacttactccttatgggagaacagtggattctaactaggacaggacacagaaaaatcctctaaagcagggcacagaaatcttctgtgtcttcatctggctggtgagtacactgatcctttcaaatacaaaaattcattggattatatata

SEQ ID NO: 99885 - DNA, 839 bp, Homo sapiens
  misc_feature (32)..(32): n is a, c, g, or t
cggccgcctactactactaaattcgcggccgngcgacggagggaggtggctattgctataaatgggttttagaagagatcattatgaaggaaccattctgtatcttggctggtggtagtcacactgatctacacctatgataaaatttcagagctaagtacacattacatgtaaaatgagtgaaatctgggtgttggtagattgtatcaattgtgtcagttttctgtctgtgatactgtactacagttatgcaaagtgttaaccattggagggaaactgggtgaagggtatatggggtctctccttttttcatacaactccatgtgaatttacaattatctcaaaagtgaaagttaaatattttttaattgctgacagctttcataaaactatagaattatatgtaggaatattaatgttaaattttagtgtaaaattttaacatatagtgtctgcgagcactttgaataatggactatgcacaagagagggtcgtattggaagtataaagatggttcaaaatgaggaaatctgttaattcaatactaccatattaaaaaaagaacatatgatcctttccataaatactgaaagggatattaacttcaacatccatttctagcatttaaaaaagaaatcttagcatgggcatcatagtgagacccagtctgtatcagaaattaagaagttatctgggcatgttggcatgtgccagctacttgcaaggctgatctgggaggattgcttgagcccaggaggtcgacgcttcagtgaactgtgatcgtgctactgtaccccagcctatgcaacagagtgagaccttgtctcaaaaaaaaaaa

SEQ ID NO: 99886 - DNA, 1454 bp, Homo sapiens
cttataagccccccctttggggcgccctttggaaaaaaaaagggggtgacggaaaatggggcccccccgggggatatttcttgggcgccccccccttgtttgttttgtagttttgtaattggttgttttttatattccagtaaaactttatttagataaataaggagctagacagattttgcccatggaccatagtttgatcatggccaacctatgatctaaaccaaagtccctaggcaagttgcaatagaaaagttgtgtgagacagtgagattttgcctttgttattcaatggcaagctagcccatgctgacacagaaattggtcccttgttttttaaaatgctaaaatactgaacactggcttaatggttagctggcaggcattcaggaaattgctatcagaagatggaagaaataacttacacaagggtaatttatattatggaaaggtgaaactgccccttgagataacctgaaaggcagatcatctaccctttactaaagaaaaagacagaaaaacaaaatattttgtagttgctgttcactgcacttgacaaaacgtacagaagagatgaactcagaaaagactggtcagtttgcaggcaaaaatgaaaaggaagagaattcaaattcaagtacttactgggtaggatgaggcaacattttaatatcaaaaagaaagataaaaatgggaaatccttttaaaaataaataaaaagagaaatcctttagccaaaaggttgattaaaagccagttttgccgccgggtgcagaggctcacacgtataacaccaacattttgggagcccgaggcgggcggactgcttgagtccaggagttcgagactagcctggggaatacagcaagaccctgtctccacataaaaatacaaaaattagctgggtgtactcgtgtatacctgtattcccagctacttaggaggctgcagtgggagaattgcttgagccaggaaggcagagattgcattgagctgagattgtacctctgcactccagcctgggtgacaaagtgagaccccgcctcaaaaaaaaaaaaaaaaaaaaaagccagttttgcagcaagcaccaaatcactggatgactatgacacctactgttaagatctctgaatgacttaatatgcctcagactaaaactccaactaagattatactagttaatcccataaattggtcaaaatggcttaaggaaacagactaagggtgtggctttcccacctaagcctgaaaagcctcagttacccagaaattaagttcagagaggcatgggaacaagaaggcaaaggaatacagcaaactttagaagtatacattaactagatgtcacttttgggtcatctccctttgggtgataaggacattctgcaggtgtaaaaacaagtgaactgaatatatagtgaccagaagggctgagtcagtcttctactttgtta

SEQ ID NO: 99887 - DNA, 264 bp, Homo sapiens
agacgtctcaaagtcaactgctcttcatttcaccaatatcatattagtccatgtcactggcctacctccttctaatatgctttccaaatgcatccaatacagtcttttaaaaatataaattatgccaggcacaatggctcaagcctgtaatcctagcactttgggaggccagggcaggaggattgcttgagcccagaagtttgagatcagcctgagcaacatagcaagaccctgtctctgcaaaaaataaaaaacgggttgggt

SEQ ID NO: 99888 - DNA, 209 bp, Homo sapiens
cggaaccccacttcgccccatgcccccccccagcagcctagtgcaagtgctgggcagtcaggacggtgcctaagtggacctcagacatggctcagccataggacctgccacacaagcagccgtggacacaacgcccactaccacctcccacatggaaatgtatcctcaaaccgtttaatcaataaagcctcttccgcagctcaggctcc

SEQ ID NO: 99889 - DNA, 703 bp, Homo sapiens
gctcaagtattccacctgcctcagcctcccagagtgctgggatgacacgtgtgagccatcataccaggcccctgtgttgatgtcctaacttccaatgtgataggattaggaggtggggcttttaggggggttcttaggtcatgagggtagagtcctcatgaatgggattagggcccttctaagggggccccacagagctgcctcaccctctttccgccatatgagaatgcaatgagaagacagcagtctgcaaccggaaagaggggccccactagaacccaaccatgctggcactgtgatttcgaacttcagtctctggaactgggagaaatcaatttctgctgttttgaagctgcccggtctacggtatattgttagagcagccggaacacaccaatacgggcatatccttccagcggagaaatggaactcttctctggtgataacaaaccaagaatacagagagtcataggaccgtggatgcttcttttttttttttttagacaaggtctcgctctgtcgcccaggctggagtgcagtggtgcaatcacagctcactgcggcctcagccttatgggctcaagcaaccctcccacctcagcctcctgagtagctgggactactcagcctggctaattttttttgtatatcttgtagagacggggtttcaccatgttgcccaggctggtctcaaactcctgag

SEQ ID NO: 99890 - DNA, 393 bp, Homo sapiens
cacctcctgggttcaagcgattcttgtgcctcagccacccaagtagccgggattacaggtgtgcgccagtacgccctgctaatttttgtatttttagtagagacggtgtttcaccatcttggccaggctggtctcaaatgcctgacctcaagtgatccacccgcctcagcccctcaaagtgttgggattacaggcgtgagccaccacacccggtctaattttgttgagttttaaaataatttttatttagaattttatgtaggtgtttttaaacatatgacattatatttgaaatttgttggtatggtaagtcgtaaacatactaaggaatttaattatatactgtggccttggcatttcctctgaaattgtgcgttatttgttctatcatta

SEQ ID NO: 99891 - DNA, 373 bp, Homo sapiens
ctcctagcttcttaaaggcagggaccctggaaactaataagaggccatatttattgagcacttgctatgtgccacctactgtgctaaccattatttccgcgagtcctcaacagcacaggaatggaagctccctgagggttgagtctttggtttgccaatgttctctaggtctaggacaaggatctaatagcatgtagtaggtgcccaagaaatactgaatgaacttcctttgagctaggtactcatgggcccccacttttcaatggaagaagctggggcctggagaggttaagcagcctgcgtacccaattgcatggcaggaggcagcagaggcaggattcaaactcaattctcaccaactcgacttttgtat

SEQ ID NO: 99892 - DNA, 757 bp, Homo sapiens
agctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggatgtaagcagttgggctcagcaggattatgagggctcaaagaagcccaataaattgcatcccacttcctggcctaagctcagaactgagaaagaagacaaaaggaaaagcagatgagagacccaatggtcacttttattaatggccatacttctgttggagagggtgacttacatcatcaaccaagaggtttacctaatactgaaccccagatttagacagccttacatgcctagccacaggcaacgctggaccaaggcaggctccactgcaacagcaggcctgctgccaaaactcatggcagggaaaggtggagcaaaatatgggctgagagggaaggagacaatcatgcctagtttttctctttccaaattcatcaaagagtttaagtcactcctcaatgtaaaaggagaga

SEQ ID NO: 99893 - DNA, 229 bp, Homo sapiens
atcctgagctgttacactataaacacagtggcgctctctgtcattcttggaaaaactcctaaattcttaaagccttcctttgcaaacggtaatggggtttgctctttgtattatgtggtggtggttgtttgttgctgtgtagttttctgcttttttgactgactcccacctccatcctagttttggttggtggtcaagttgggagtttttcattgtatccttaattcac

SEQ ID NO: 99894 - DNA, 377 bp, Homo sapiens
tcagtctagctcagcattgccaaagagaaacataacgtaagccccttaagctctggattcggtttttccactgtgacttcagtgtggctggattgttggactgttctctctcagagagtccagtgtggccggataacttggactgttctctctcagaggctctgatcacatgactcctaggagtcctaaagcatcatctcctccccatgttagaggatctaacttgtgaacattgaaagtggctagaaagttgggacgctttgctccgtgtggtatgatggaggctgagcttccctctggggcttttcgatgataaaggggatatgcagcatggtttacaatcttattaatggtctggtctgtggtgctggctttct

SEQ ID NO: 99895 - DNA, 489 bp, Homo sapiens
gacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatac

SEQ ID NO: 99896 - DNA, 284 bp, Homo sapiens
cctctggtccatgcttttcttgggggaaccagagatgcagtggctgcatgggaactggagcttccggtaggcatttgggaaatcttttctgagaatttagatgggacgatttaaattagggaactcctgatttgggtttgcatggccccaactttttgtgtgactccaaaggggagtaaagagaaaaactgcaggatacttcaggggaaagtggatgagactctctggacaccattcccccactttttcttttccttcttcctttctttcttctttttttttag

SEQ ID NO: 99897 - DNA, 111 bp, Homo sapiens
cagccaggccggcatggatttctgtagcttggtctctgtgctgcctcagtacacagtctcgcgggcctcctgcagactgtggggagctctgggtaaggtctgtgtggagac

SEQ ID NO: 99898 - DNA, 451 bp, Homo sapiens
tttctaattcttatatgaccaatggctcaagcaaatttcaaaagaaatgtcttaatctcaatgtctactttcatgtgaactgggaattactctgaaaatagtgtttcgtagccatgggttgtccatcattgttttgaagtaattttttaagcttatgtgtatatggatgagagaataagaaaagaggaagcagactgggcatggtggctcatgcctttaatcacagcactttgggtggctgaggcgggtggatcgcttgaggtcaggagttcaagaccagcctgaccaacatggtgaaacaccacctctactaaaaatacaaaattagccaggcatggtggcgcatgcctgtaatcccagctacttgggaagctgaggcaggagaatctgcttgaaccaggaggcagagtttgcagtgacccgactgcgccattgcactccagtctaggca

SEQ ID NO: 99899 - DNA, 144 bp, Homo sapiens
aaaattcaaaggcagctacatatatgggggaatttagaaagtcactatgcatgcccagaggaaaaggcaggctgagaaaaagagaaaggccttaagtttatacctcaggcttatttcttacacagaacactttataacaattta

SEQ ID NO: 99900 - DNA, 613 bp, Homo sapiens
taccgagacattccattgcccagggacgagcaggagacggatgccttcctcttgtctcaactgcaaagagccgttccttcctcttttaccaatcctcctcagcacagaccctttacgggtgtcaggctgggggacggtcaggtctttccctttccacaaggccatatttcagactgtcacatggggagaaaccttggacgatacctggctttcctaagcagaggtccctgcggccttcagcagtgttttgtgtccctgggtacttgagattagggagtggtgatgacttttaaggagcatgctgccttcaagcatttgtttaacaaagcacatcctgcatagccctaaatccattaaaccttgagtcgacacagcacgtgtttctacgagcacagggttgggggtaaggttacagattaacagcatctcaaggcagaggaatttttcttagtacagaacaaaatggagtctcttgtgtctacttctttctacacagacatattaacagtctgatctctctttcctttccccacaccttaccaaccgatctggatcccagctccctctctgactttgggtgatattcaaaatgctaaacagcacaaaatggtat

SEQ ID NO: 99901 - DNA, 712 bp, Homo sapiens
  misc_feature (685)..(685): n is a, c, g, or t
attcggcacaggagatgataaactgaagttcagaaaggttgtacagttttccccaacttcaccaggtttctaaatgtgttttagaaccaaaatactttggctctaaagtccacaacaaagtatgtctttctttgtatattctcttattctcactgctttccagtagaacaatccccttcaatatgagatgatccttttagaattaactgtctgggccagagtgcattatctgaaaaccaagaaatatagggatccacctgttaaaggcagacacagctacatacacatgtctccctaatccaagatggtacacctatccttgtctagggatttgctagatctgtaatatactacctatctcccctaatcagtcctagtaacaatacttgggatgacagattagaatattagcctaaggtataactagtctactaacaaaatactctagcagtttgggaaggtgttgagtagattttctttccaaagctgatttgttgtattactaccataattttggaagtattttatgaactaaaagttagcaagcccccataaagtttaactctctagaagcaacttctacacatgaagaatctagctggttagtgcctgagccccaactgattttattcttttagcctctacatgtcaagcacagctcattaactccaactctgtactttcnttaagtggtggcctcacatttgctctt

SEQ ID NO: 99902 - DNA, 505 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcagtcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99903 - DNA, 382 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgtcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99904 - DNA, 167 bp, Homo sapiens
tcgaattcaagcttctaacgatgtacggggacatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99905 - DNA, 963 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatgctgcgaaggccgtggaggaacagctgagaaagtcgttccagatccgctgcggcctggaggagagcgtgtccgaggggctgaacgtgccgcgctccaagcggctcttccgggacctggtgagcctgcaggtgccggaggaacaggttctgaatgccgcgctcagggagaaattggctctcctgccgccacaggctcgagccccgcacccaaaggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99906 - DNA, 1043 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatgctgcgaaggccgtggaggaacagctgagaaagtcgttccagatccgctgcggcctggaggagagcgtgtccgagggtgaggggggcgggcggccggccgcgtgcgggagtcggggtgaggcgcgccactcacctccgtccccgctgcgctctcagggctgaacgtgccgcgctccaagcggctcttccgggacctggtgagcctgcaggtgccggaggaacaggttctgaatgccgcgctcagggagaaattggctctcctgccgccacaggctcgagccccgcacccaaaggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99907 - DNA, 1039 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtgagcgggggaggctggcccccggcccgcgacggcctcgcgcccacctggtcactgccctgccctctgctcccaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatgctgcgaaggccgtggaggaacagctgagaaagtcgttccagatccgctgcggcctggaggagagcgtgtccgaggggctgaacgtgccgcgctccaagcggctcttccgggacctggtgagcctgcaggtgccggaggaacaggttctgaatgccgcgctcagggagaaattggctctcctgccgccacaggctcgagccccgcacccaaaggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99908 - DNA, 1140 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatgctgcgaaggccgtggaggaacagctgagaaagtcgttccagatccgctgcggcctggaggagagcgtgtccgagggtgaggggggcgggcggccggccgcgtgcgggagtcggggtgaggcgcgccactcacctccgtccccgctgcgctctcagggctgaacgtgccgcgctccaagcggctcttccgggacctggtgagcctgcaggtgccggaggaacaggttctgaatgccgcgctcagggagaaattggctctcctgccgccacaggctcgagccccgcacccaaaggtgatggggtctgggcgtggggcttcctccatgtacccccttacccggatccttcctcccaaagtgtaaccttgctttgggcccaacctcccaacaggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99909 - DNA, 826 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatgctgcgaaggccgtggaggaacagctgagaaagtcgttccagatccgctgcggcctggaggagagcgtgtccgagggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99910 - DNA, 1003 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatgctgcgaaggccgtggaggaacagctgagaaagtcgttccagatccgctgcggcctggaggagagcgtgtccgagggtgaggggggcgggcggccggccgcgtgcgggagtcggggtgaggcgcgccactcacctccgtccccgctgcgctctcagggctgaacgtgccgcgctccaagcggctcttccgggacctggtgagcctgcaggtgccggaggaacaggttctgaatgccgcgctcagggagaaattggctctcctgccgccacaggctcgagccccgcacccaaaggagccacctgggcctgggccagacatgaccatcttgtgtgacccagaaacgctattttatgaattcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99911 - DNA, 860 bp, Homo sapiens
ggaggggcgggggaaaggaggcggcagccaggctgtgtcccctgaccgttggagcgtctgcgacccccgcatccccgcaccctcaaggcacctccaaagatgatgatgggttgtggggagtcagagctgaagtcggcggacggggaagaagccgcggcggtcccggggccacccccggagccccaagtcccgcaactccgagccccagtgcccgagcccggcctggacttgagcctgagcccgcggcccgacagccctcagccgcggcacggcagccccgggcggcggaaggggcgggcggagcggcggggcgcggctcggcagcggcggcaggtgagcgggggaggctggcccccggcccgcgacggcctcgcgcccacctggtcactgccctgccctctgctcccaggtccgcttccgcctgacgccgccctccccggtgcggtccgagccgcagcctgcggtgccgcaggagctggagatgcccgtgctgaagagcagcctggccttgggcctggagctgcgggccgcagccgggagccactttgatcctgccgccacaggctcgagccccgcacccaaaggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaaaaagaaacttcttggaggcctaaa

SEQ ID NO: 99912 - DNA, 215 bp, Homo sapiens
aaattactgacaatctgttgaaacatattttgtgtcattcttatatagaagtattgtcagagaactgatgtagtgtctagtaagttgttccaaattggttggaaaacatgttgtagctgacccacctggacagcatgcatcaaagatctgctgccctttccccacttctgagctggcccaattctattctattgtgtttcctctgtgcaaaacca

SEQ ID NO: 99913 - DNA, 1045 bp, Homo sapiens
caggttggagtgcagtggcatgatcatagctcactgcagcctcaaactcctgggctcccaagcaagcctcctgcctcagcctcccaagtagcagggattataggtatgtgccaccacggttgcccaagctgaactcctgggctgaagcagtcgccctgtctcggcctcccaaagtgctgggactataggtgtgagccaccacacccagtctcattagcatttttacttgcccctctcactagacctcctgcgtgttgagagtttgagatctagaaaggtgatgagtagcaaaataagtttgctggatgattatgacgatgatgatggcagtgaatttagctcttaaataacaatgatgaaatggtctgtaaaatgtctggaatgtgtgtgttcctgatttagttttctgcatgtactgtaaattaaaatggaaaatattaagattttcaaatgttaaaaatcaacttgataaaagctgaaaaaaatcatggtccaatatctctaaatgatacagtatttgtgattaatggggcctaattcttgttccaccttgctgatttttctagttatttcctggtaagagttatttttttttccccgaagttgctagaattgcttttaaatatgtcagatgtcaaactgaataatgtcaccaactgtctgtaaaacaattagtacattggtggattgattatactgtttttgtttgtttgttttttgttttgttttgagacaggccttgctctgtctaccaggctggagcgtagccttagctcactcaaagtctggggtccaagtgatcctcccacctcagcgtcctaagtagctagtactacaggtgcatgccaccatgatggcttatttttaaattttttgtagagatagggtcttgctatgttgtccaggctggtgtcgaactcctagcatcaagtgattctcctatcttagcctcccagagtgctggaattacagatgtgagacactgcacctggtttctcttcttaacttaatgatatattattgattcaatagaagtcatttatct

SEQ ID NO: 99914 - DNA, 202 bp, Homo sapiens
taatatgaattggcaaggaaatcttcagagcctggtaaactgttttctctacttttaacatatgtaatggattcatgatcaaaatttgatgtgactgattgaattgtcttttattattatttacctcttctggtgttcagtatttgttatatactctaccctttttcttgacaaaaaatgaaaccagaatgttatgtattca

SEQ ID NO: 99915 - DNA, 412 bp, Homo sapiens
gctagtatggtgctgtgcacaacaggagctcagaacatgttttaaacagctggaagcatggattctgacattgtcaagtcacttggttaaacttgttccttctctccagtttaacagtctaagcctgtttattgtggaatccaatagaagaacaagatcacatggctttgggggggtcttggagatagaaagatgccactggcagcaagtgtggaggaaagagtgctccttaaactagaatatgatagttaatcccagctcctgagtaaagcctaaggtggaatcaattatgttgacaaccacctagatttctcttacagaacagtgccagtgctgtcttgttcttcaggtctcaaacacatggcaactggctctttcctagagttctctcaaactgaagaacaaaaaggta

SEQ ID NO: 99916 - DNA, 660 bp, Homo sapiens
actattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaaggtaatgtc

SEQ ID NO: 99917 - DNA, 467 bp, Homo sapiens
gctgcccctccggtgaaaacagaggaagtgggagcggcaggaagcgctttgggaccagggcgacccctgaagcgtagaggaaccaggtcacaagcatacgtgaatgctcacattccatagttatcaaatgtattcaggtttaaattttacttttctagaaaaaatgtaaataatccgttgagaatatttaatgaaaaatgttggtcgtatctttatctggtctgcggctctgtccctgtttcctggataggagactacgtctgtatcttgtatcacaggaggcaccttcttcctgtttcctggcacagactttaaatcttagtgctcctcactctttgcgtctacgctgcttttatgaactgttaacactcactgtgaaggtctgcagcttcactccttaagccagcgagaccacaaacccactgggagggataaacaactccagacgggaggaacaaacaacttcg

SEQ ID NO: 99918 - DNA, 235 bp, Homo sapiens
tgctgccttgctttcgtgcagttaagtagaacatggtatatccacagaatggcttactgtgcagccataaaaaggaggtagaggtgtatatttgtgttctgacctgtaaagatgctccacatatctgtctaaatgtgtacaggtatgtgtgtataatgcatgtacgtgtggatatgtgtcatgtgtgcatatgtcctttgaaatcagggctgttcagccttgggttgacatttgg

SEQ ID NO: 99919 - DNA, 277 bp, Homo sapiens
cagcttgactgctcctgtggacagtatcaatggatacctgctcaccatcccttgctaacttctcttattcatggtcagaaaagagtttgatatgattcaactcttttgaaaagaatatgattttcccttgatttcaatattcaaggtaattcgtgggcttcacataacaggaagaatagtgctggctacctcttactgcacataaatatataccagcccctgaactcaacagcagagccagaatttaagccagggctgtctggtgtttctacagcct

SEQ ID NO: 99920 - DNA, 390 bp, Homo sapiens
ttcccttggatgactggtctctgtgttcctacttttccttctcctcctccctcccaactccaagacctaaacagggcttggaatttctgcacactggtcaaaaagcaaattctatcgaaagcaaacagaagcctaggcaatcctagacgagttagacccggctggtatttgtcttcctgttagagagctcagggatccaggtgaaactgatatcaccaaggagaatgaagtctcctgtgacatccccatagaaagcaaaaacacatttcacagtcaagatcaagcaatgatgtagcaaaaactctactctgccagacttgcagaggcccagatttcccctgattgtctgtgggcataataattcagaggaagatcatctaaaccaatgtc

SEQ ID NO: 99921 - DNA, 350 bp, Homo sapiens
caactttgggaaagtgaacattttaacagaattgagtctttcccttcattgcataagttcttctacagttactttcaacattgttttgtatattcagtatagaggacttacacattgttcaatttatttctagacatttaatgtttttttgatgctgttgtaagtggtggagttttttttttcccccagttttattttccaaacatcttgcctagtgtatggaaacaaaatttatttttatatattgatcttgtattttgtgcgcttgctaaattcacttatagttttggcagtatgcagatttgtttttgtttttgtttttgtttttaatgtgctgtcatgccatctgg

SEQ ID NO: 99922 - DNA, 670 bp, Homo sapiens
ctgctctcaacatggctcacacgtgactgttggcaggaggcttctgttccttgctggctattgataggggaccttggttactctccatgtaggcctctccatagagctgcttgggtgtcctcacaacatggctgctggtttcccccagagcaagtgatctgagagggagagcaaggagaaagccacaatgcctattatgacctagtctcagaagtcacactatcagttccaccacttttactcatagaactgagtcactaagtctagctcacactggaagggaagggatttaggcttcacttcttgaagggagggttaccaaagaatttgtggacatattttaacagaaaattttctaattcaaataattacaagacctctatcaagacaactctggccaggcgtggtggctcctctggccggagtgcaatggctcatgcctgtaatcccagcactttgggaggccgaggtgggtggatcacttgaggtcagaagtttgagaccagcctggccaacatggtgaaacctcgtctctactaaaaatacaaaaattaaccaggtgtggtggtgcgcttctgtaatcccagctacttgggaggctgaggcaggagaatcgcttgaacccaggaggcggaggttgcagtgagccgagattgtaccactgtactcc

SEQ ID NO: 99923 - DNA, 514 bp, Homo sapiens
tgaggaagagaaagagctggagtcctttaaaattaactgcctgtttttccctctgtggctagtgagccttatctctccacttcccaggcattgtgaagaccctgtttctctagctgtgcagctgcaaggtcactagacagataatctcaagtcgtaaaacatgttgttccttaaaaagtaagaaatgatgtaatgcatgtcttaactgaataactgtctttgtttcttgcttctgtaatacgcttccccctgcacagatctacccccaccccacgaaatgcttaaaaggtagcttgactttttgttcaaggctcagtcctttggatgttaatctgactgggttgatgcacctaaacaattaaataattcctcctcaacccctccggtctctctgattccttaattatcccgctgcagtgtctctactaaaaatgcaaaaaattagccaggcatggtggcacgtgctgtagtcctagctacttgggaggctgaggcaggggaatagtttgaaccc

SEQ ID NO: 99924 - DNA, 517 bp, Homo sapiens
gagcggggttattgtaggcacccccatactgttctccccacttttatccttgtccctctttagtctgtgtttagtccctcaacacatcagtcaaagtgatcccattaatgtaagtcagggaatttcatatctttgctcaaaatcttctgatgtcttccaatttcaacaagagtgaaagccaaaggcatgcccccaaggctctttcccgaaatcatcatctttctctccctctctttcactctgctgtagccctacccatttccttttctttttttcttttcttttttttttttttttttggagacagagtcacccgggcgtggagtacaatggcatgatcttggctcactgcaacatccacctcccgggttcaagcaattcttctgcctcagcctcccgagtagctgggattacaggcacacgccatcacacctggctaatttctgtatttttagtagagacagggtttcaccatgttggccaggtgggtcttgaactcctgacctcaggtgatcca

SEQ ID NO: 99925 - DNA, 225 bp, Homo sapiens
atcacacaatctcatctcggctccaagtggaagcttgctcagcaccacggccaacctgatcccactgcagatgttccaacagcctggcacgcagatggcccagggcaaaagcctcatcgaatgctgaatacctgtgagatcatttcttacaaagccaaatgaacaacactatgttaattttcaaattttggcatggaaatcacattctaagacgcttcccaagct

SEQ ID NO: 99926 - DNA, 425 bp, Homo sapiens
tcactcctttagccaatatcatgaaactctgaaactttatagcaggatgaaaacttaagcctgtagtctaaagacccagaattatgagtgaggaaactgaggccaggagagccatgaatgatagtgtttacttgattgctgtttcagatttcaccagcttttattgatacttcagcattttacttagtcgatatatctcttcgtgtgactcaaagtatcccagtggagcacagttaactgccctggatccgaattgccactggaggccgtggcagtgtcggcatcaatagggatcacccatgaccttttatttgggatgtagtagggggtctgaagttgggaaagtctgaggtggtactcagttctgggttgaatgtcttgtgaaaatcctgtgaatacatcttgcggagaaacacagaggggaa

SEQ ID NO: 99927 - DNA, 764 bp, Homo sapiens
cgtcacctccatcatccgctcctcccagacgtctctggtcacctgtgtaaatggactccggagcccccctctgacgggagatctggggggcccttccaagcgggcccggcctggccctgcatcgacggacagccatgagggcagcttgcaacttgaagcctgccggaaggcgagcttcctgaagcaggaacccgcggatgagttttcagagctctttgggcctcaccagcagggcctgccgcccccctatcccctgtctcagttgccgcctggcccaagccttggaggcctggggctgggcctggcaggcagggtggtggccgggcggcaggcgtgccgctgggtggactgctgtgcagcctatgagcagcaggaggagctggtgcggcacatcgagaagagccacatcgaccagcgcaagggcgaggacttcacctgcttctgggctggctgcgtgcgccgctacaagcccttcaacgcccgctacaagctgctcatccacatgcgagtgcactcgggcgagaagcccaacaagtgcatgtttgaaggctgcagcaaggccttctcacggctggagaacctcaagatccacctgaggagccacacgggcgagaagccgtacctgtgccagcacccgggttgccagaaggccttcagcaactccagcgaccgcgccaagcaccagcgcacccacctagacacgaagccgtacgcctgtcagatccctggctgctccaagcgctacacagaccccagctccctcc

SEQ ID NO: 99928 - DNA, 561 bp, Homo sapiens
aaaccccttctctggtatttaagaatctctgaccaatcccctactatgaatcagggatagtgctgggcactttcacatgcatttatatcatttactccacaccacatcttcatacacaaataaggcctccatagacccctgggcatgtaagaaaactgatgttcataagttcacatccatggcaaatgccttgttaggaaatgaaatgtagttttatcaacttttgtatctgcggctatttccatcaatattacagcagcacccacttcatcttattattatttgtgtggttatcttactttctctattacaatgacattttaaaacaagaattgaatcttatacagtctaacataagtttcaacactcgctatagaaatgcctggtttatagcagctactcaaagaatgtttcataagaaagttgtgttccaagtattctggtgaatgccaatgctggttcacaatgatgggggtctgagaaccaactgacctccctgacattgtgtgaagcaggaacataccgaacctttactggaagttggaagaggaagatgagagc

SEQ ID NO: 99929 - DNA, 300 bp, Homo sapiens
atttaggctaaattgtgggagctaataacataaagtacattgatttatttatcacggctagcagatatttgagaatgttagcatagctctgacactgtctacccagagacagtcccagatcccacagattgaatggttcagtccccaacactgcccccacaccattcccaagtccagacctccagaacttctgactgactggcttcaagttggggaccctatgaccacctctttgggtttgattaatttgctgtagcagctcacagaactcagagagacactgacgtttcctggttgaat

SEQ ID NO: 99930 - DNA, 285 bp, Homo sapiens
aggaaaacaccaaccaatctgaggtttaatgggtttaataagtttacctctcagttcctacttgtagcacccaatattcctttgaaaatatgaaacagacctgtcagtggccagcagtgaatttctgccccgccaacagagttgaaaagttcaggtactctgagcattgtgttgcagtggcacttgtccagaattggtacctccccatagttgggggctttaaatgtaccagtgaaaatagctttttcctcttcaagcggaagaaagaaaatcactcctcaaaac

SEQ ID NO: 99931 - DNA, 607 bp, Homo sapiens
actgctggtgaccaaatcctaaaaggagccagctcatctgagggcagagctggaactcagcatatcaatgaaaaagtgtgagaataccttctcctccaacatcaaatggtccaatctccacctagtcaaagtgactaaatttgtctcaagttgtaaagttatttgaagaatttttaaaaatcattctttttatttttattttttagtagagatagggtctccttatgttgcccaggctggtctcaaactccttgggctcaagcaatcctcctgccttggcctcccaaagtgttgggattacaggcggcagccactgtgccaacccagcctttagtagagacagggtcttgctatgttgcccagactggtctcaaactcctagcctctggcaatcctcccatcttagccttccaaagtgctgggattataggcatgagccactgcgctcagccccatttaaagacctttgaaggatatactagtacttgtaatgatgacgtggcactaatataacacataattgtattcctccaaaattacttgcaagggttgctactgaagttcagaaaagtctaataatacatggcatgccccaccaatagtgcag

SEQ ID NO: 99932 - DNA, 382 bp, Homo sapiens
agagatctttgcctattttgttcattgatctgtcccaagaactaaaacagtgcctggaacattgtggatgctcaatacatatttgttgattgattgattaatagtagctaatatttattgagcactaatgtgccaagggtactagtaagtgctttatatatattattattgttattattattattattactctccccattttatagatgagaacattgaggcacagaaaggttaagtagcttgcctaagttcatgggactagcaagttgtagagccaaagttcaaacacactctagctctggtttggttctggagcctctgtattcttaaattccaaattacctcaccttttcatggttggtggatgtacagaacaatctca

SEQ ID NO: 99933 - DNA, 460 bp, Homo sapiens
tgctggtaggccctggagcagatgcatttcatctggtttgcaggtcactgaactcatccctgaggattggaggaggaggtaatgcccctaatgcctcgcagttcttaaaaggattggctaaattgatagctcctcatgccgtttgtcactgggtgggcaggaaaggatactgagaaggctgggatggctccactgattgtctctagcctgtgggtgctctccaatgtcagccttaccttttcctccagacctcctgcctctgaaggtcagactcaaagtcagacttggccaggggttagagggagagactggcaaccgaccatctcaggctgccccacggtgttcacagaaaccccttccagaacactagtttcctaaggaagctacagagtgctgggctgagagcagcaagggatggggaggaaggggaggaaggcgaaggggagtttgtttgcgtcta

SEQ ID NO: 99934 - DNA, 96 bp, Homo sapiens
tgccaggatacaatggtaaagggagcacaggccctgccttgactgaagagatggataataaccaacatctgtgtgcctcaggaacaaatgaagatg

SEQ ID NO: 99935 - DNA, 516 bp, Homo sapiens
attatatatcataccttatactatactctagcggtgatgcgatacatggccgcagccttttgttatttggaaacaagatatgaaacaatcaacttggttgtaagggaggagaccacccctcatattgtcttatgcccaatttctgcttccaaagaaagaagaagtaaaaactaaaggcagaaatggaatccacaggcagatagcccagcactgtgccctgggcctggtagttaaaaatcaacccctgacctaactgcttgtgttatctatagattgcagacattgtatggaaaagcatcgtgaaaatcccttcctgttctgttcagttctgattactggtgcatgcagcccccagtcacatatccccacttgctcaatcaattacgaccctttcatactgaccctcttagaattgtaagcccttaaaagggacaggaactgctcactcagagagctcagtttttggagacatgagtctgccggtgctcccagctgaataaagccctttccttctac

SEQ ID NO: 99936 - DNA, 393 bp, Homo sapiens
catttcttcttggtcctgcgtctcctctatgtaacattgttcctaatgtttttgacctttgtttctattgatcaaggctgtgcttgaacattttacctagaatcattgatcctagtcttactaatcccccaacccctaagaatcttccaggtggaacatttctatgcatcagttcctgggatccctgacatgggagcactgtataactaaaatagtggatcagaaggtatcttagaggaactccatgacaaagcaagagaatgagacagttggggcatcctttacatgtctgatccctgccacagaggcatggttttcaccccattctgattgtgaagggtctggggtaggcactctgtgtcaaactgcagaacaccacggtgctaaactcag

SEQ ID NO: 99937 - DNA, 600 bp, Homo sapiens
acttggatataaaaattgtgcaggtgtgaatggctgcaatttggaactaccctatcccacaacgccacctctgtttctgagggacaccgtaacttaggacgctggcaggaggtggtatatgagaccctttgtgcatgtatgtctgtatgtgtaggtgtgtatgcgtgtgcatgtggatgagtgtttggacgtgtagataaagtgagtattcttctggttatctttgtatctttgtaaaatgaatccccctcttataaccaccatagggcttcataaatgccatgtcctacagtattcttctgtagttggattctaggacgtttgcatgactgttctaaaaagcttggtcatatttgaagaggaggacagtccactaacacgcacagctgggaatgagatccagttttgcaaagggatttgtgttttaatgacacaaatgtgagtcctcatctgcttcttaaactgtcagcaagatcaccaaggctgttactaatgtaagtgtgtatgggggtaagcggctgggtgagggactgctaggtaaatgctctcggccttgtacctgtgcaaagcccatgcttgacgggggatgcccgagaggga

SEQ ID NO: 99938 - DNA, 752 bp, Homo sapiens
cgcgctgtcgcccggccggtagctaaggaggcccagctgtgatcccgaggctttgtaggcgccgcagccctggccctctagaggccgacggaggagtgcgggggaagttagcttgcgcctgtctcgtcagccgtgcacgagaaaaaaaaggaccttcgagaagaacaagggagggcaagagttaccgagtacagggacatctatgtggccgctctgctttcccgccgtcacctgctgttgaactccggccgcatcgcggtgtccggagccgcctggcctggagtatgcgctgagcgtcacctaggcaaccacccctgcacctgtggatcaggtgggggaaagggaccgaccgcgttcttgtcctgctagagttcgactccgcctggggcttggtctctgcttcttgaaaacattgtttttttattttgtttctgttttgttttgttttgagacagggtctcgctctgttgccaagggtagaatgcagtgtcgggatcatagctcactacagacttgacatcctggactcaagagatcctcctgtgtcagcctcccgagtagctgggaccactggcgcgcgacaaataatttgaaagtgggaggaggggaacagaaccacatcaaatggcagatatcatagaatgagaactgaatatacgcgttttgtgggaaacgcgttcttttcccctttctctaagattcgcttttaattcactagccactaaccagttacctatctcattacagatata

SEQ ID NO: 99939 - DNA, 628 bp, Homo sapiens
cgcgctgtcgcccggccggtagctaaggaggcccagctgtgatcccgaggctttgtaggcgccgcagccctggccctctagaggccgacggaggagtgcgggggaagttagcttgcgcctgtctcgtcagccgtgcacgagaaaaaaaaggaccttcgagaagaacaagggagggcaagagttaccgagtacagggacatctatgtggccgctctgctttcccgccgtcacctgctgttgaactccggccgcatcgcggtgtccggagccgcctggcctggagtatgcgctgagcgtcacctaggcaaccacccctgcacctgtggatcagggtctcgctctgttgccaagggtagaatgcagtgtcgggatcatagctcactacagacttgacatcctggactcaagagatcctcctgtgtcagcctcccgagtagctgggaccactggcgcgcgacaaataatttgaaagtgggaggaggggaacagaaccacatcaaatggcagatatcatagaatgagaactgaatatacgcgttttgtgggaaacgcgttcttttcccctttctctaagattcgcttttaattcactagccactaaccagttacctatctcattacagatata

SEQ ID NO: 99940 - DNA, 246 bp, Homo sapiens
tcttgttctcctcttacctactgtcaccgttctcagcaacagcaacatctatgtggccaaaaagccaacaacctagtccgtttttgccccactttccttcaattctacctcaaccaatcctttttaatatgatcacatactagactttgtcatcatcagaaagtgtgcgaccactgaaatcttgagacttccattctccatccaccatttctgattcatccatgtcatatgctctaacacagtcat

SEQ ID NO: 99941 - DNA, 243 bp, Homo sapiens
tccctaatggaatgctctgtcctgcttgccagttttggtgcagagaagccaacaaagatttataaatagggatgctcatgacatcatgatttatgacaggtaaaaacaggaagcattttagatttcaaacaaaaggtagttgatcaaatatatcactacacatccaagtaactaaatagcacatttattaaaaacgatgagtctaaagaataattaatatcatagggaaaacatttatgtaaa

SEQ ID NO: 99942 - DNA, 313 bp, Homo sapiens
  misc_feature (26)..(26): n is a, c, g, or t
  misc_feature (160)..(160): n is a, c, g, or t
gcctgtaatcccagcactttgggagnccgaggcgggcagatcacaaggtcaggagatcgagaccctcctgactaacacggtgaaaccccgtctctactaaaaatacaaaaaattagccaggtgtggtggcgggcacttgtagtcccagctacttgagagnctgaggcaggagaatggcttgaacctgggaggcagatcttgcagtgagcagagatcacgccactgcactccagcctgggcaacagagcgagactctgtctcaaaaaaagagaccagattctattgcccaaatagtatgacatggtgcagtttt

SEQ ID NO: 99943 - DNA, 708 bp, Homo sapiens
ctctgggttcctggagggcctctccgggactcgaggaaaacgaccttttcccttgcagcggcgggagagggcgaagtggaggactgctgctcggttccgtatccaaaagagacccaaggctccaggcaaaatagattggacattttcactttctcaagccagggccaccggtcgcccaaccagcagccactgagggtggtatcggggcgccccttcccctggcagcgtatttcagcccccagagacatcccccacctcggccatccccagcgcctttgcagggacagcagcacaaccatagcagaggtcctgggcatcctggaaataacgtgctggtgatctggctcagaagtgcacgttggcccgcgcgtgcggggagctgagaagcaagagattggaactttgcacgtgtcaagcaaggtttggcctgctttgaagacagtaatttcagagccactccggtctctgcgtcacaagcgggcatcagggcagtggtggggcggcaggggatcctgagacctcccatgccctctctttggccccggtgcttctgggcttcaaaatggttaactgaaaagaacggaggtcacatgacaacatgagtatatcccccaaggaagcctacctgtctatccccaggaatctgaaccagcagacaaagcactgtcgggtccttgctgcaacctcttccccccaccccctttgatg

SEQ ID NO: 99944 - DNA, 165 bp, Homo sapiens
tcacctctacaaaaaaatttaaaaatttcctgagcatggtggcatgtgtctgtgatcccagctactccataggctgaggcgggaagatcatttgggcccaagaagtcaaggctgcagtgagccatgatggcaccactgcactccagcttgggctaccttgcctca

SEQ ID NO: 99945 - DNA, 762 bp, Homo sapiens
aacatgagagagaaaatcaatgaaataaaagtagaatacagaaaaccaactaaatcaaaagcgagttgtttgagaagagcaattaaattagtagactcctagctaaactgatcaaaaaaataaagaagatccaaatgtactaacattagcagggaaagaggggacagacatcactacagattctaacatcgataaaatgataaaaacttaattattataggattaatggcaacacatttgaccatttagatgaaatgagataattctttgaaagatataaaactccctcaagaagacacaaataacctgaatagccttctgcctatgaaaggaattgaatttgtaattaaaaacctccttcccacatctaggatcaaatggccttgctggtaaatttaccaacttcccaagaaaaaaaggatgccaattctaaacagacttttcaggaaattggagggaacacctctcaactcattttacattttacatcagcacttccctgatcccaaaaccagacaaaagccagacaagaaaacgacagatctcatgaacatacatacacatacctccacgcataaaaacaatattcaatcagtgtagaagtactccacctaaagagcttctacagaacttgaatccattagttaaaaatactaaaatgccacactatttcattagtttgcaacaaccactgattagtatcacagaggactatatttattagctaaatttcaatttaaaccttaacctaactgatggatg

SEQ ID NO: 99946 - DNA, 100 bp, Homo sapiens
cagaatctccattatgtatgaatcaagatcctggctgacattttctgccttggctgttgtgagctttcccgtcagaaatatccttcccatggggcctgaa

SEQ ID NO: 99947 - DNA, 130 bp, Homo sapiens
gctcattatttgtactgtttgttttatttttgatgggtggtatattttgcatagtagtggatacatttcttcagtagattaacttgtactatgtgccatacactgtgtcagatgtggacagcagtgaaca

SEQ ID NO: 99948 - DNA, 233 bp, Homo sapiens
attttttccctctaaaaaaaaattaatttttctcttattatttcatgtatgtagttgtctgtctccaacttgattataaattcattatatttcatttcttaaggttagaaactttccatttttttttgttcccacctacagcttacagagatagacatatagtaggctgtcaataaagtttggtttattttttgctaactcagagcacacttataatctacttattcttcacc

SEQ ID NO: 99949 - DNA, 414 bp, Homo sapiens
ctccaccatccagaaccagcccaagatccccaggggttcctgaagcacacgctgtggtttctcaagccccaacacccttggcttgtgctgtgccctcagcccggtacactcttcccctgcctaatgagcaggtacccctcacagcctcgatgggacagcctccaggacagctctgtccctgcgttcccagcctgtactgttgctgtctgttactccccagtcacccgggtcctgcttcctgacacctagtattaatacaaggcccagcacgatgaggatttttcagatggaatgtttagggcttagggctctggggacactctgcatagggagaaacagccttccacgtcaggcattctgagagctcctctacgagggcgacagagcaaactgcaatgacagatgctggggtat

SEQ ID NO: 99950 - DNA, 430 bp, Homo sapiens
taaaagggggctcagctgtgacaagtaactctaggccgggaactggaggcaggagctccggttctcttcagcttttgtggtgctagctagatgagggatatttctaaaattctaagtctatgtgaatcaaatcatgaattgtttgaagagtaagttggggaagagaacatgagaataaaatttataacatgcattgttaatccttttaattgcattgggtagaacgattattaattcagtgcacctgtgctgtgggttgagtactgaaaatagaggggtgaagaagaccatttctgccctcagggagcttccttgcttgcattgttcgttcatggagcattcatagatgtgcccttgccctggcactgtgtcaggagtcagaaatgaggcgttctacaggcctcctgtttactcttctaggcctggtggc

SEQ ID NO: 99951 - DNA, 591 bp, Homo sapiens
tagtgagtcttgagctggcttgaggtgtgttggacctggtggttgctaaaagcaattaagcgggcatctgggtcagctagtagctgttaaaaagattaaagggaggtgaagacgtgtagcactgaaggctgcactggctcactgatacctttattttctcagaattgaaaagtttttcatagttgtaaagatagtcaataccataggtttcacttttactgcaggaactttccaacgagaggtttctctcgttctttctttaattttatctttctctcactaggcaatgctgcacttaacagtatattgtaaagcttgaagtactgtattacgttgcctggctgttactccagtgctaggaaagtggttggaaggatgaggaagacaatgaacaaaaggaggcatttggaaggatttgttttacttcaaaaacaagaatactaagcttccatcctgctgcttaatctgtttcaaacccattacatgtagtataaagtgtttgggtacttcgttaaatccaacagaatagagatggtcttaaaaggaatttccctgccctaaagctctaagggtggctaaagatagggtgtt

SEQ ID NO: 99952 - DNA, 694 bp, Homo sapiens
cttgcacgttaatgtcagagaaaatggtcataaattttaaagggtgatttcctttccacccactccctctaccttcacttcaataaatcaccctcctaaaacggcagggtggcaaagcccaagggcaaaggtcaagggggcccctcctgacctgatccctcattaacatttagcagctcccaagtggaatgttctcaagggtttccagaaatgctggggtggttaggagggggcagacaccttgctcagagaggcagcaatcaggaagcagaatattcgctcattcaccactcactcactcacatctccccatagaaagggggatttacacagggcattcattctctgggttgtggaggatgcccctgaaccctgatcaatactcacaggcacactggtacaaacacagccaggaggaaacagtcgactcacatgagcatgtgagtgtgtgtcaggggtttttttgagtgacagagggtgccagatgagtggtgctcttggatcaccctgtcacaaatttcctgaaccacaaaaagggccatcagtttaagcactgatttgaaattcactatgccaactgattcatttctgtaagcacagaaaggccccttggcactgtgatatgcacctgggtctggagtcagtggccctggggtctggctacaacctctttaagccaatgtccctgagtctg

SEQ ID NO: 99953 - DNA, 110 bp, Homo sapiens
gaaacaccactgcctgaaagcactcgtgcccacaaccaaccaaacaggatctggggaagcctctaaatccgtgcaccgattggcagaagttcagaggaaaacgttaacag

SEQ ID NO: 99954 - DNA, 532 bp, Homo sapiens
cccattttttttcttagaggaaatgtttgatagtttctcctaaaaaattaataattggcacaaaagactagttttgtgtcaaaagtagttttgagttttatctaaagactgacattggcttgaagttgggctttccagattcaaaaatctgccccagatgagatttagatgcagagggttagtgtccttttccccagggggatggccgtgatgatttgttcaagattgtgttatagtagctgccccttttaagccagctgtgtgtgtgtggtggggggtgggcagtgtgtattccacatcaacatcctagaaagaacgaataaacatttagtgatctcactgtttctacttacatttggtataatgtactgtttttattggtgctattacctatgttaatagggcactttacaaaattttcaagaacgtttttattaaaattatttcaaagacttctttcttaaaatatgattttaccatgtaaaaaattatactaaggtagaagaatattcgttttctcattttctgaaaa

SEQ ID NO: 99955 - DNA, 673 bp, Homo sapiens
caaggaattaacatctaatattttccttgactcataagagccttcattcttctggagggatagcaacaacttaacagatcacggaaatgccatctaataaatactgtaataaggttatacaaacagtgtttgggagctcattaagggaacacgtgaatttgacataagcctggggaaaatatctcagaaaacaaagtatctgagattcaggtagtgaataaaacttgtaagacaaataaaggggaacagaaaagggcattcttggtagaatataactttatattctcagtaggaacagtaggaagcaccatccagaggtagaagactttcaatagatttattcactcaacatatatttatggcatgtctcctatgtttcagacaccatctgaggcattggttatagcatgaacatgatatacatgtctctgcctttatgtctagtctgttgttggagaaagaagcaataaactgtaaccagtgaatgaatgagttgaaagatgctttaggtcatttcctctgtatgagataaaggtgaaagaggttccaaatcctaatgtatatgttgaaatataaagaattctagaatgtaagctccatgtatacagaggtgtctgtaatttcattaatatacctttagcgcctaggacagtacttggcacgggagtactca

SEQ ID NO: 99956 - DNA, 170 bp, Homo sapiens
gctccacatcctcatcaacacttggttgccagccttttccattttaactattcttttcatattcctaaggaaaatactcataaaatgatttgtctgaactcttgagcaacaaaaaaaaatcaaactttcaacgaagactgaagtgaaactcattatacagaaattttaat

SEQ ID NO: 99957 - DNA, 252 bp, Homo sapiens
tgagacggagtcttgctctgtggcccaggctggagtgcagtggcatgatctcggctcactgcaagctccgcctcccaggttcacaccattctcctgcctcagcctcccaagtagctgggaacgaagggttcttcaatgggatgaccctagctagtaattcagattcttacatatgacagcaaaaataatctagaaatgtcttgtcaagtttgcttagaacaagaggaagaagacaaatccagtccaaaaatg

SEQ ID NO: 99958 - DNA, 175 bp, Homo sapiens
tgtgtacagaggtgagtaagatgtagctcccattctcaagtcgcttacattctaatgtaaaaggtagacaaagcattacagaagaagtaactctgctatagaaggttgcaatgaagagaacattggaaacactaattttaccttataaagaaggtttcataaaggaaggcaagtt

SEQ ID NO: 99959 - DNA, 833 bp, Homo sapiens
tcacacgtgccagccccttgctccctgcacatggcctccttgctgactcaggttcctactcccctgctcccccgactagcggggctctgactcagctcgcagccccacctgaccactgttcttcattcagattgtccaaggagaaccagatgatccctggccagcctagtgatgaggccctgtgagccaggggttaccttgtatagtcagcatttcagggaagaccaaaaggacaatgggaggcaaattcattgccacatgcccacacatacattatctcatttatttatgtaaaagcccgttttacagataaggaaatggaaagttaaagagtctaaagggtttattcagctataaaaaggaatgaagtgcagggactgacacgtggtgcagcatggaataacctggaaaacatgctaagtgaagggagctgatacaaaagaccacatatgctacagttccatttgaataaaatgtctagaataggcaaatccatagagacagaaagcagattggcgattgccaggggctgcatagaaagggggatggagagtgactgctaaataggcacgggctttcttttggggtgataaaaaatgccctaaaggccgggcgcagtggctcacgcctgtaatcccagaactgtgggaggccaaggcgggcggatcatgaggtcaggagttcaagattggcctggacaacatggtgaaaccccatctttactgaaaattcaaaaattagccaggcgtgatgtcacatgcctataatcccaacctcaggaggttgaggcaggagaatcacttgaactcgggaagtggagattgcagtgagcc

SEQ ID NO: 99960 - DNA, 554 bp, Homo sapiens
attcattttcatccacccctgagacattcttacactgaaattggagaccactggattactatgaacactggtctaaatctaaggtgatctttgggcttataattcaggaagtatggggcttgtccttaaatttggagccatgaacctttagcttcccagtgcatttctgtatcaccagcaatatactctcaggcctgagcaaggagactgcttccctggaccctcctcaatctttttcagctcagcttttttcaacatgctcctcctcatgggataagaagtcctcagggcccaggagcatgccacagtgtgccctccaccttctaagttccactgtgggtatccagaactctatcaaaagtaagccatcctacaaaagtcaaccaatatgtgcaattctagtccagagggatggctgttcgtggtgagctgtgaacaaataggcagtctggacatgcaggctgtggtatttcccatccacacacatgtgcaatgaggatactcagcacacaagagagggccagggctgcacagagaagggggatggtcaagaa

SEQ ID NO: 99961 - DNA, 322 bp, Homo sapiens
gattctcccaataaggcattgctattaagcttaatttaagtacagaaacttccctaggtttccccacctgcttgctagtggcagtgaaacctgcctcatactctaaccctataggacagtatgaggtatagaaaagcttcaaaagattgggggtaataaacaaaaatagtagaaaagggtttgggaaaatgaggagtgttacaatatggagtttgtaacttctttaccttctctgtgctttttttatttcccacccattcacctcactttggcattgggtagggaaagaagaaagcctgtcctatgataggtgctatgccat

SEQ ID NO: 99962 - DNA, 485 bp, Homo sapiens
ttgccacccaaccagtggggagtgggaagattactaaacttggagtcagctgacctgatttagaactcactccactactaattagctttgtgaccttacagagattgcatagcctctagcctcagttttcctctctataaaatgggtatagctcctgactgatctaccttactgggatgtaatgacaatgagaaaatgtgaagagcagaatgctttaaacatgtgggctttgataagtggaattatgaccacgtgaagtcattcccagaagcaagagtctctcccaaattctttagattttttttttagcatctttttcttccgtcttactaggactctaatgaggatgcctatgagtataatacatggaacagttcccagcttagaatatatctctgatttttacttaaattcgtcattgcccatattcaggtttctattcagtccaaattatatgctaatgaggatggcatatttatacattc

SEQ ID NO: 99963 - DNA, 278 bp, Homo sapiens
gacaaaacacaataatgtaattaacttgtttcgaattttgtaaaatgattttattgcaaagttagctaaaaataaaactctagtgtttaaacaaaacaaaaccaaaaaaccccactactgataaacaacctcagcaaagtctcaggatataaattcattgtacaaaaatcactagcattcctatacaccaacaacagtcaagtcaagagtcaaatcgggaaaacaatgtcattcacaaatgccacaaaaagaattaagtacttaggtaactagggagg

SEQ ID NO: 99964 - DNA, 351 bp, Homo sapiens
taaatttattcaattttattgtgttttttaaaaagcagcttatgccacaagcacaaatgagctttctcagttttcaactcaaaatattatatgaaaagatggatatgtgtgtctgtgtgggaggggtgtgaattggatgacggttcttagggtattacagaattcagccagtggtggaagtctaaggttcttattgaatggttcaacttctttatcaaagaagttccatgaagatctttgataacctgtttaaatgtacagaatttttcaaaagccactgtgaaaagcagtaccataagttattttttaactaaaatctgtagaaagtgtttccaaaagagttcctttttt

SEQ ID NO: 99965 - DNA, 482 bp, Homo sapiens
tggtggctcttttagctgggcctcaagagagatttgaggaaccgaacctttaacagcagcatcctttgcggcattatcagccaagactgtttcctctagcttccgcagaggttaaccttgaatgtccgggagtttccataatagccaaggcagctggcagctggatggcatccagtaagtcccgtacataggatccatttttaatttgacctccagtggacgtgagtaaaccccttcatttccatagcagtccaaaatcaggagcaaccccaaaggcatatctactatctgtatagagtaacagattgccctttcacgaggaggccagcaagggcagtgagtttagcttttcgtgcaaaagtagccacaggggccaggcgcagcagctcacacctgtaatcccagcactttgggaggccgaggtaggcagattacttgaggtcaggagttcaggaagactggccaacatgacgaaaccctgt

SEQ ID NO: 99966 - DNA, 739 bp, Homo sapiens
atcgtgaggggagcgcgtcgtgtggagggcgtcgtgacggggacgtcgtgaggggcgcgctgtgaggcgagtctctgccccctccccctggagctcccgctcctcagctgccccccgcagtcaggggctcttcctgtcagtgcctcatgggccctgcattcgcctcccccaggcagcgcggtcctcctgggggagtcagcctgtctcgcctgagcccgaaggccgcctccccttctgccacagccccctttggctcccggctctggagatctgccctccagtggatctgtctgaaaccgccctcccttagccgggcgggaggcagcaagcgcgcgcgctgcgggcaggagcggtttctgcaggagggaccctgcccgagctaaacaccgagaagacggcaggaggcagaaggcgagatgggggaaaggaagataatctggaaagttccactgcaggaaagacagtcccggtggccagctggcctctcagaggccccttagtaagccgaggacccgaacccttacggaaatgtaattgagacaagcccgaagcagagcggaacgaaacagaacagaggagacgcgggcacaggagagcgcagagggagctctgggcgcttaaggaatggagactgcagcgggccagcgggggctaagtcccggggtcgcagatgcctgtgtgcgggggcaggtgcttgcgtgcggggcctgccccagcccctgcctggcagaaagcccca

SEQ ID NO: 99967 - DNA, 481 bp, Homo sapiens
aattcggcaagaggactccaatgattttactttctttgcttggcttaatatccgtggatcttgctatcttctcttgagaagaacttggcctttcattctaatgactcacaaaagaaaaggcaatgacacctggggcacatatgtttttctggtcaattcaaaaattctctttgaccttttctttcaagtagatttttttaaatgcatgactggagaattatcttcaatgattcatgatgagaggcaggtaggaattggttaagaagtatgagcacggaaaaaattattgtttaatcacatgaaaggcaacatctgttccagttcataaagcacacagtctcgaatggaagaaaaaaaggtccttcgtaagaatactgatgcataagataaagacgaaataatgaaaaagaaaaatgtatattattattcccttgtccattctcaagtttaagctgcggttgtcagttgaatgtgaaatgat

SEQ ID NO: 99968 - DNA, 311 bp, Homo sapiens
ggaagagatggtttatcccagaccagaagaatgagtcgatttggtaaagacagtagaagaagaattcccaagaaagtgactagcatgtgaaaatcatgagaggatggtgtgaaagaagccaatgtggccagagcacagagagaggctactggagagataggcaggaggcaaacatgcatggttgtgggccacattcaaggtgttggccattatcccaataactatagatatctgctgaggattttaaacataaaatggcatgacttggttgaaatttgaatcagatcccttgagccatgatgagaaacaga

SEQ ID NO: 99969 - DNA, 352 bp, Homo sapiens
attcattatttcaccaattgtatcacattatttcagtgactatattttgtctgcctatttttacatcctacaccaggaccaaattttcctgttgttccaggaatttctgtctgtgtgtaaacacaaatcagtttttaaaatttaggtttgtattgtacatactgtctgacaacttactgttgttttctgtttttacatggcagctttatgaaatttattacaagtggagatagtttcaatatagttttaatatacgtctgtgtgtgtacgtgtgtgtgtatgtatatgtgtgtgtgtgattttatatcccttttatactgaagtgtactcataccattgcctcaccttctta

SEQ ID NO: 99970 - DNA, 1820 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99971 - DNA, 769 bp, Homo sapiens
agagaatgatgagcagccagttcacccaatggacctgcctactgcagcgtaggcctcgcctcaacggcaggagagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattgccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99972 - DNA, 538 bp, Homo sapiens
gagggatttgtagtcctgcagaaagttcatccatacccaggatggcaatgatatcctggagggatttgtagtcctgcaggatcttttgcaccccacgggcaacatcgtaatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99973 - DNA, 487 bp, Homo sapiens
agcggtccggaattacgggatatcgaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99974 - DNA, 3201 bp, Homo sapiens
agagaatgatgagcagccagttcacccaatggacctgcctactgcagcgtaggcctcgcctcaacggcaggagagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcaaaaaaaaacaaaaaaagaaaacaaaaaaaaaaaaaaaaaaactcgagactagttctctctcttgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaat

SEQ ID NO: 99975 - DNA, 689 bp, Homo sapiens
cccacgcgtcgcccacgcgtcggtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99976 - DNA, 399 bp, Homo sapiens
gaggggggtgcagatgactctgctgactgtctctgaagtattcagccacagtcagcccagtcagagctacccgggcacgagcaccaggtggttcattcatttgaccatataccagcgctaccttagaggtggcatcttttaagttgataacaccagattcaatcatttcatggtataaatcattgccttcacgggtcctctcaccaacaccagcaaacacagagtaaccaccatgggctttggcgacattgttgattaactccatgatcagtacagtcttgccaactccagcaccaccaaaaagcttcatttttctgtgtaggctgcacaagagccttgattgaagatatattctttctgaacagtatttaaggtttccaataaaatgtacacccctca

SEQ ID NO: 99977 - DNA, 964 bp, Homo sapiens
  misc_feature (860)..(860): n is a, c, g, or t
  misc_feature (870)..(870): n is a, c, g, or t
  misc_feature (899)..(899): n is a, c, g, or t
  misc_feature (907)..(907): n is a, c, g, or t
  misc_feature (921)..(921): n is a, c, g, or t
  misc_feature (931)..(931): n is a, c, g, or t
  misc_feature (937)..(938): n is a, c, g, or t
  misc_feature (944)..(944): n is a, c, g, or t
ctaggaaggccggtgttaatcggccgaggcagtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggcgcggtatttggtccaatgatgaccacctggggctcgtgccggntactctgacngggcggacgggggtgaaattcaagaacanaggcaagngcggcttttggacntcttcgtccnggcggnnaggggntttggcccccttggggatac

SEQ ID NO: 99978 - DNA, 908 bp, Homo sapiens
  misc_feature (13)..(13): n is a, c, g, or t
acgctacggctangtacgaggctggtgtgtaatcggacgagggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaagctcctaggatcgcggctttggtcaatgatgacccccggcgccctcccggtactccatggccagcggggggcaacccaacaaa

SEQ ID NO: 99979 - DNA, 967 bp, Homo sapiens
  misc_feature (851)..(851): n is a, c, g, or t
ggcatgggactatgacagtggtacaaaaagcggctggtacggtcggaattcccgggatatccgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaagaggcnggttatggtcaatgatgaacacctgggtctggccggtactgatggggaagggggaaatcgaaacagaaggaagtggtttggaattgtaccaggggaggtgggttggactcgggggc

SEQ ID NO: 99980 - DNA, 908 bp, Homo sapiens
  misc_feature (908)..(908): n is a, c, g, or t
aaattagggctaggtacgaggctgggtgtgggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggaccccgtaggcctggtttttcctgtactggttgatctggggtttccctttaagatgccccctaggaggcggggtatggcaagtttagccctgtgtgtgcccgttctcacgggtcgggggtttacaccagcccgctgttgtgtacactctcccgcagccttgacccagn

SEQ ID NO: 99981 - DNA, 2360 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcaaaaaaaaacaaaaaaagaaaacaaaaaaaaaaaaaaaaaaagaaaaaagaagaggggggggggggggaagagaggaggttcccgggggggggccaagtgatagcgcgcgcgagaaccacgggattactgtgtggaacacaggggggcccaaaggagggggcgagcagaaataatacaacaaggcggaggggcgcgaggatcaaaaaaggagagagaagaacgggaacacacaccggcaacaaacggggagaaacataggggcaaaagagaccccctaaccgccggggggggagacacaaagtggggcacacaaataccccacgcagaatatttacagaggccccaaggagagggaatatttaataaaatgtatagaaagagagagtgatcagatgggggtgtgtgtaacaaacagataggtgacaaattataagtggtgaggtgtgtagagaaaaagtttctggagcaaacagaggagagattgatgagttgatggcgagaaatttattacagcgaggagctatatgatgatagatgtaa

SEQ ID NO: 99982 - DNA, 2091 bp, Homo sapiens
  misc_feature (1831)..(1832): n is a, c, g, or t
  misc_feature (1837)..(1837): n is a, c, g, or t
  misc_feature (1964)..(1964): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcataaaaaacacnnaccanagacaacaaaaaacactttgttgggcggcctcgcgcctccgtgaaaaagttgttaggagccattgcgttgggcgcgcgggccccagtagggtccgtgcacgtggccagagtggtccaaggaaacctngtcggccatgggctgggttcccccaataaaaagcgccgggcacggagcgtctggaacaatccgcatgggttggaggcctactggctctccccggcgccaggagtcgagtaccgcgcgcggtggtgtc

SEQ ID NO: 99983 - DNA, 2390 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcaaaaaaaaaaaaaaaaaaaaaaaaaaaaaaaaaaaaaaacaaaaaaagaaaacaaaaaaaaaaaaaaaaaaagaaaaaagaagaggggggggggggggaagagaggaggttcccgggggggggccaagtgatagcgcgcgcgagaaccacgggattactgtgtggaacacaggggggcccaaaggagggggcgagcagaaataatacaacaaggcggaggggcgcgaggatcaaaaaaggagagagaagaacgggaacacacaccggcaacaaacggggagaaacataggggcaaaagagaccccctaaccgccggggggggagacacaaagtggggcacacaaataccccacgcagaatatttacagaggccccaaggagagggaatatttaataaaatgtatagaaagagagagtgatcagatgggggtgtgtgtaacaaacagataggtgacaaattataagtggtgaggtgtgtagagaaaaagtttctggagcaaacagaggagagattgatgagttgatggcgagaaatttattacagcgaggagctatatgatgatagatgtaa

SEQ ID NO: 99984 - DNA, 1894 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcaaaaaaaaaacacaacccaaacaattaacctccccatatctctacaccaaccgtatccttctctccccctctcct

SEQ ID NO: 99985 - DNA, 1838 bp, Homo sapiens
  misc_feature (1818)..(1818): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaaccttccttgtttataaaacaccacgaggtttaaangttccaaaagatgtcccccc

SEQ ID NO: 99986 - DNA, 1840 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacctgtttgtcgtaggcagatgtcatgtgacgggatccttagagtcacctcagcatcc

SEQ ID NO: 99987 - DNA, 1663 bp, Homo sapiens
  misc_feature (1578)..(1578): n is a, c, g, or t
  misc_feature (1581)..(1581): n is a, c, g, or t
  misc_feature (1587)..(1587): n is a, c, g, or t
  misc_feature (1591)..(1591): n is a, c, g, or t
  misc_feature (1596)..(1596): n is a, c, g, or t
  misc_feature (1600)..(1600): n is a, c, g, or t
  misc_feature (1603)..(1603): n is a, c, g, or t
  misc_feature (1605)..(1605): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcagtganttnaccttnccgnaaagncttnttngnggaccattgagaaatctggacacacgatagggtcaaaacaataggaggagtaacccac

SEQ ID NO: 99988 - DNA, 1581 bp, Homo sapiens
  misc_feature (1422)..(1422): n is a, c, g, or t
  misc_feature (1428)..(1428): n is a, c, g, or t
  misc_feature (1436)..(1436): n is a, c, g, or t
  misc_feature (1440)..(1440): n is a, c, g, or t
  misc_feature (1443)..(1443): n is a, c, g, or t
  misc_feature (1449)..(1449): n is a, c, g, or t
  misc_feature (1452)..(1452): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcagactacaatccctccaggatatcattgcatctggtatggtgacttctgggnagacangtgacgtnccgngcnggaaanacngcgtctggtcagcaaccagggggaggctaagcattgggagggcctcagggagaacagagtacagatgggggaacgccacaaagctatggcccaagaggacaatcggacaagagcgggggcgcccaatgg

SEQ ID NO: 99989 - DNA, 2338 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaagaggtaagcattgagctaattgatgtccacgtggtagttacgccaggaaactattgccaactgaagccatgttctatattttctatttaatttttttttctttttaagaaaatgttaatattttcattttcgtgtcccagggcctacaaaggaaacctgttagtgttttcccccccaacttccaatacacaaatggacattttctttcctctttgatactgacattaaataacatttccaggttttctttttggtagatagtcccatcatttgaaagctaattttgggagggctggattggacgtggtacatatgtttcagttaagcctattttgtacttttcacttaacttgaataggtttttatttcctttctactatagttttgccttactaatataagaagctgtcttttttttttgaactgcatctctaatagggaaaagaaacttgcacacaaaaacgctgacaccttctgagatcctttgtcaggttttacgattatgtatgattactgcaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99990 - DNA, 1326 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggcgtctttatggtcatacccgcttgctagcataagagtaccgagatt

SEQ ID NO: 99991 - DNA, 1786 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaagctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99992 - DNA, 1768 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacacaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99993 - DNA, 1832 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacatgttcccataaatgttcaccttcgaaaaaaaaaagaggagaacaaacagagggggggcccaaaaaaaccccgcggggggcccattacgccaccgcgtctgttacagggggccccagagaggcatataacacagggcgcaaacagtgcgtgaaaaggactgacgtcaggacactctggttgtcaccccatacgcaacaatatgtgtagtcgggtcacttcatacatcagcagcacgacgagcaccaaacccaaggaggggc

SEQ ID NO: 99994 - DNA, 1454 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacagtcttgtaaggctatctatgtgcctgtgatgattgaatgacctgccctgtatagttgcatttgatgtacatgtatggtggtgcatggtgagctaggattatcagtggggatctttagataattgtatatggtccaacttgggggggagctagattgcgggggtgaaagattgggataaaatgcaggaattgcctggttggtatttcgaaaagtgccgggcggggaaaaggtctttagcacaagggtgtaaggtggaagggctagacaatcgtggggaaatcaagttggagagggag

SEQ ID NO: 99995 - DNA, 1523 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttggggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99996 - DNA, 1661 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 99997 - DNA, 998 bp, Homo sapiens
  misc_feature (882)..(882): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaagaggcnggttatggtcaatgatgaacacctgggtctggccggtactgatggggaagggggaaatcgaaacagaaggaagtggtttggaattgtaccaggggaggtgggttggactcgggggc

SEQ ID NO: 99998 - DNA, 1026 bp, Homo sapiens
  misc_feature (922)..(922): n is a, c, g, or t
  misc_feature (932)..(932): n is a, c, g, or t
  misc_feature (961)..(961): n is a, c, g, or t
  misc_feature (969)..(969): n is a, c, g, or t
  misc_feature (983)..(983): n is a, c, g, or t
  misc_feature (993)..(993): n is a, c, g, or t
  misc_feature (999)..(1000): n is a, c, g, or t
  misc_feature (1006)..(1006): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggcgcggtatttggtccaatgatgaccacctggggctcgtgccggntactctgacngggcggacgggggtgaaattcaagaacanaggcaagngcggcttttggacntcttcgtccnggcggnnaggggntttggcccccttggggatac

SEQ ID NO: 99999 - DNA, 1174 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaagaggtaagcattgagctaattgatgtccacgtggtagttacgccaggaaactattgccaactgaagccatgttctatattttctatttaatttttttactctctctacaaggttttttcctagtgtcctaagagctgttcctctttggactaacagttaaatttactaggggatttagagggttctgtgggctaatttaaagttgaactaagattctatcttgtacataccagctatcatccatggtctcggtagttttgtcgcctctacctataaatctcccccagtgattttgcca

SEQ ID NO: 100000 - DNA, 1151 bp, Homo sapiens
  misc_feature (969)..(969): n is a, c, g, or t
  misc_feature (985)..(985): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggggcgcatcgtggcggtcattggcgcattggtggacgtccagtttgatgagggactaccaccaattctaaatgccctggaagtgcaaggcanggagaccagactggtnttggaggtggcccaccatttgggtgagagcacaggaaggactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100001 - DNA, 1025 bp, Homo sapiens
  misc_feature (890)..(890): n is a, c, g, or t
  misc_feature (894)..(894): n is a, c, g, or t
  misc_feature (900)..(900): n is a, c, g, or t
  misc_feature (908)..(908): n is a, c, g, or t
  misc_feature (915)..(915): n is a, c, g, or t
  misc_feature (918)..(919): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggccggttatggcnatgnagaccnctgggccngcccggnacnnacggggcgggggaaactccacccgaggcgagcgggttgagacctctccagggggaggttaatggcgcacccgtggaccacccggggtgggaaaccccaggcctttg

SEQ ID NO: 100002 - DNA, 959 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaagctcctaggatcgcggctttggtcaatgatgacccccggcgccctcccggtactccatggccagcggggggcaacccaacaaa

SEQ ID NO: 100003 - DNA, 938 bp, Homo sapiens
  misc_feature (938)..(938): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggcggcaaccactccttcacctttgatgctggggctggcattggcctcaacgaccactttgn

SEQ ID NO: 100004 - DNA, 1736 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcagggtgagtatattactatgtgggatcagtgtccggaaagtcaaaaagagggcctgtggggactatatgaggactggatctttcttagtgatttgttttggagcaaggaaagttgaggctggcaattgctagtgagagctaatgaggtctcttgagtttccaggtacttaacgctttggaatgcaatatttttctttctttttttttttttttgagatgagtctcactgtgtctcccaagctggagtgcagtggtgccatctcggctcactgcaacctccgcctcccaggttcaagcgattctcctgcctcagcctcctgagtacctgggattacaggtgcgcgccaccatgcctggctacttttgtatttttagtagagaccaggtttcatcagttggtcaggctggtctcgatctcctgacctcatgatccacccaccgtggcctcccaaagtggtgggattacagacgtgagccactgcgcccggcggaatgcaatatttttctaacagcaccaaactaggactatggagaacaagacactgatctttcttggctgagggccctcataacaccaccaccttctctgccccctagcatgtaactttccctttgttagcttgtccaaattaagggagtgagaatacttaactcagtcttcttttttctcataggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100005 - DNA, 929 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattgtttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100006 - DNA, 731 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattgccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100007 - DNA, 396 bp, Homo sapiens
  misc_feature (5)..(5): n is a, c, g, or t
  misc_feature (126)..(130): n is a, c, g, or t
  misc_feature (139)..(139): n is a, c, g, or t
  misc_feature (149)..(149): n is a, c, g, or t
ttctncctcgccttttcggttttgggtttgcgttcacctcgctgttttgttttgtgctggcttggcttattgttctttgttgcgctttgctctttttcctgttttcggggttccttatcggctgcnnnnnttccagcangattttggcnggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100008 - DNA, 239 bp, Homo sapiens
ctttcgttcttctgagtttgctgaagccagatgcaatttctgagaaggaataggatggaaggaagcaattactttttttgaagtttgcttatttaggaaagcagaactcttaaatattctttcttttcaacctcttatagggctttttggtggtgctggagttggcaagactgtactgatcatggagttaatcaacaatgtcgccaaagcccatggtggttactctgtgtttgctggtg

SEQ ID NO: 100009 - DNA, 413 bp, Homo sapiens
gctgtgcaggcgctttatcgatcgctgcgcggccttccctcttggacacgcgttccgtacaagcggaaagaggcctgacttcggctgagttttcctctccttgtgtgttaagtcctggcttccgatgacctttaactggcctgaccccagctccttccaatatcttttgtctgttagtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtaagtagagtttgttaggaatagtaaagaccttgtgtagcccaaatatcccc

SEQ ID NO: 100010 - DNA, 981 bp, Homo sapiens
  misc_feature (2)..(2): n is a, c, g, or t
  misc_feature (17)..(17): n is a, c, g, or t
  misc_feature (846)..(846): n is a, c, g, or t
  misc_feature (850)..(850): n is a, c, g, or t
  misc_feature (856)..(856): n is a, c, g, or t
  misc_feature (864)..(864): n is a, c, g, or t
  misc_feature (871)..(871): n is a, c, g, or t
  misc_feature (874)..(875): n is a, c, g, or t
gnggggggggggaaacncaaaactaaggctaggtacgaggctgggtggtgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggccggttatggcnatgnagaccnctgggccngcccggnacnnacggggcgggggaaactccacccgaggcgagcgggttgagacctctccagggggaggttaatggcgcacccgtggaccacccggggtgggaaaccccaggcctttg

SEQ ID NO: 100011 - DNA, 2274 bp, Homo sapiens
  misc_feature (2216)..(2216): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcaaaaaaaaacaaaaaaagaaaacaaaaaaaaaaaaaaaaaaaaaaaaaaaaaaaaaaaaaaaaaaaaaaaaaaaaaaaaaaaaaaaaaaaaaaaaaaaaaaaaggggggggggggaaaaaaccccggggggggccatggccctttttaagggggcgccccctaatgaggagggagcgctttataataaagcgagcagcgagcagagcggcgcgcgcggttgtataaaacaacagaggtcgggggcgagaggggaaaccaccggtgcgcggcggggcgatgttctggggagggagagagacccccccacacctctgggggggcggggcgaacaatcatgtgggcaccaaccaccccccgaggaagaattaagacgctccgggggaaaatacaaacatngaggcgttgtcacatggggccgacacccccgggattatcgcgggggcagaaaaaatgc

SEQ ID NO: 100012 - DNA, 2233 bp, Homo sapiens
  misc_feature (2175)..(2175): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcaaaaaaaaaaaaaaaaaaaaaaaaaaaaaaaaaaaaaaaaaaaaaaaaaaaaaaaaaaaaaaggggggggggggaaaaaaccccggggggggccatggccctttttaagggggcgccccctaatgaggagggagcgctttataataaagcgagcagcgagcagagcggcgcgcgcggttgtataaaacaacagaggtcgggggcgagaggggaaaccaccggtgcgcggcggggcgatgttctggggagggagagagacccccccacacctctgggggggcggggcgaacaatcatgtgggcaccaaccaccccccgaggaagaattaagacgctccgggggaaaatacaaacatngaggcgttgtcacatggggccgacacccccgggattatcgcgggggcagaaaaaatgc

SEQ ID NO: 100013 - DNA, 2187 bp, Homo sapiens
  misc_feature (2129)..(2129): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcaaaaaaaaaaaaaaaaggggggggggggaaaaaaccccggggggggccatggccctttttaagggggcgccccctaatgaggagggagcgctttataataaagcgagcagcgagcagagcggcgcgcgcggttgtataaaacaacagaggtcgggggcgagaggggaaaccaccggtgcgcggcggggcgatgttctggggagggagagagacccccccacacctctgggggggcggggcgaacaatcatgtgggcaccaaccaccccccgaggaagaattaagacgctccgggggaaaatacaaacatngaggcgttgtcacatggggccgacacccccgggattatcgcgggggcagaaaaaatgc

SEQ ID NO: 100014 - DNA, 2185 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaaaaaacagagaagagaagacacacaaaacaagaaaaaaaagaaagaaataatagataaataaaacaaaacaagtaaaagaagaataacaaagaggaacaagaaataaaggaggagaacagaagagacaagtatcaaccccgaaggaaggcagagatcaaagaaatagggcagggagagcgactccaacgacataggaagggaacaaaggggggagtacaggtagagaaaacgaagaaagagctcaacataacagcaaaggatccaacagcaagggggaagcagggcaaatcatcgaaaacatgcatacagaggaaataacgaacgacaggagcaatcaaggcgcaaacaaagacagaagagaa

SEQ ID NO: 100015 - DNA, 1839 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacacaccaggagttaagttccaatatatgcctgtcggggtgcgtgtctgttggtggt

SEQ ID NO: 100016 - DNA, 2371 bp, Homo sapiens
  misc_feature (1640)..(1643): n is a, c, g, or t
  misc_feature (1646)..(1646): n is a, c, g, or t
  misc_feature (1648)..(1649): n is a, c, g, or t
  misc_feature (1652)..(1653): n is a, c, g, or t
  misc_feature (1656)..(1656): n is a, c, g, or t
  misc_feature (1665)..(1665): n is a, c, g, or t
  misc_feature (1668)..(1669): n is a, c, g, or t
  misc_feature (1671)..(1671): n is a, c, g, or t
  misc_feature (1698)..(1698): n is a, c, g, or t
  misc_feature (1702)..(1702): n is a, c, g, or t
  misc_feature (1718)..(1719): n is a, c, g, or t
  misc_feature (1721)..(1721): n is a, c, g, or t
  misc_feature (1723)..(1723): n is a, c, g, or t
  misc_feature (1728)..(1728): n is a, c, g, or t
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggacnnnngantnnatnngantaggaatanacnncngcttgctgtattcatttttgttttagnagtntcgttaatatgtggtnngnangtaanccaaaaagcttcatttttctgtgtaggctgcacaagagccttgattgaagatatattctttctgaacagtatttaaggtttccaataaaatgtacacccctcaaaaaaaaacaaaaaaagaaaacaaaaaaaaaaaaaaaaaaagaaaaaagaagaggggggggggggggaagagaggaggttcccgggggggggccaagtgatagcgcgcgcgagaaccacgggattactgtgtggaacacaggggggcccaaaggagggggcgagcagaaataatacaacaaggcggaggggcgcgaggatcaaaaaaggagagagaagaacgggaacacacaccggcaacaaacggggagaaacataggggcaaaagagaccccctaaccgccggggggggagacacaaagtggggcacacaaataccccacgcagaatatttacagaggccccaaggagagggaatatttaataaaatgtatagaaagagagagtgatcagatgggggtgtgtgtaacaaacagataggtgacaaattataagtggtgaggtgtgtagagaaaaagtttctggagcaaacagaggagagattgatgagttgatggcgagaaatttattacagcgaggagctatatgatgatagatgtaa

SEQ ID NO: 100017 - DNA, 2492 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcagggtgagtatattactatgtgggatcagtgtccggaaagtcaaaaagagggcctgtggggactatatgaggactggatctttcttagtgatttgttttggagcaaggaaagttgaggctggcaattgctagtgagagctaatgaggtctcttgagtttccaggtacttaacgctttggaatgcaatatttttctttctttttttttttttttgagatgagtctcactgtgtctcccaagctggagtgcagtggtgccatctcggctcactgcaacctccgcctcccaggttcaagcgattctcctgcctcagcctcctgagtacctgggattacaggtgcgcgccaccatgcctggctacttttgtatttttagtagagaccaggtttcatcagttggtcaggctggtctcgatctcctgacctcatgatccacccaccgtggcctcccaaagtggtgggattacagacgtgagccactgcgcccggcggaatgcaatatttttctaacagcaccaaactaggactatggagaacaagacactgatctttcttggctgagggccctcataacaccaccaccttctctgccccctagcatgtaactttccctttgttagcttgtccaaattaagggagtgagaatacttaactcagtcttcttttttctcataggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100018 - DNA, 2393 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaagaggtaagcattgagctaattgatgtccacgtggtagttacgccaggaaactattgccaactgaagccatgttctatattttctatttaatttttttttctttttaagaaaatgttaatattttcattttcgtgtcccagggcctacaaaggaaacctgttagtgttttcccccccaacttccaatacacaaatggacattttctttcctctttgatactgacattaaataacatttccaggttttctttttggtagatagtcccatcatttgaaagctaattttgggagggctggattggacgtggtacatatgtttcagttaagcctattttgtacttttcacttaacttgaataggtttttatttcctttctactatagttttgccttactaatataagaagctgtcttttttttttgaactgcatctctaatagggaaaagaaacttgcacacaaaaacgctgacaccttctgagaaaggatctgtggtcgtttctccgatttgggaaccttcagtatgtggcttctctactcctttgtcaggttttacgattatgtatgattactgcaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100019 - DNA, 1607 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100020 - DNA, 1666 bp, Homo sapiens
gaattctttcttcagcccatgtaaacatgaaaataagggttaaaaatgacttcattatggggaaaagggacaggatgcaaattgttcaaattcgtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccacattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctca

SEQ ID NO: 100021 - DNA, 609 bp, Homo sapiens
acgaaggatttcccgtgccgtgggagcgggttcaggaccgctggtcggacctgagagtcccagctgtgggaagctcagctgtgtaatttgtagtaacgaagcagaagttacaacgaaaagacaagttttcctgtgcttggcagggcccccctcccccccaccaaggcctgcagtggatagagcctagcagatcctggacaatactatcctaaaagctacatctctgacagtgatttccagcgactttgtcaacacggtccgcccccagcaagtataagaggaaaaacaacaaatgtctttactgccttgtctttcccccttgccacttgtcattattcaagttttgtaagttcctgatttccattcagtgcagctgcaaggttaccagctgtgcttgcgttgcaagacctgtcacagtttgattaactgccttctttctgcttctgtaagccctcttgcctgccccgcgagtttcacaccatcaaattcctgctgcaccattcaaactagccaaccccctttcagaagtgtgtataaaagtcaagccccctgtctttcttcggggctcatgctaggcccgagtgcattcaataaaatccttctgttcca

SEQ ID NO: 100022 - DNA, 177 bp, Homo sapiens
tagtttttcttacaaaaacatttaccaaagctctttctttctcccaaaaaatcttaatgtaaaaaaaaccaattaggcaaagatccagtttctgacagtggcttctaaatgtctctaactttcctttaataatccattagacaaattgccaggaaaattctgtaaaagaagagcaat

SEQ ID NO: 100023 - DNA, 295 bp, Homo sapiens
gacacaaccttttgaactattgctgctgttttcattttaaaaaggaacttttaatactaaaattataggaagaacataatatctgacgtcacgtaaattcagatttgaaggaaatttactttttttccttatttgttcttattttttctcattttgttaagaaccagcgaacactttgaagaaagccaaaagtttacatctggagctggagggttctgtgactgcacaccaggcactctgccagccctacttctgcctgtagtcctgcaggtcacttgccagaggtggtactttc

SEQ ID NO: 100024 - DNA, 402 bp, Homo sapiens
ggcactggccagagaaactgagttggaacgtgctgcccccttttcctttgcagccagtacccttggctgagcatttggacagggtctttcctcagttcccacccccaccacacacacaggttcccacagagtgatgtcttcactttgggggcatgagttgaattcaggctgggctcaactgccccatctgggaaccaggtccttgttcagttgacttagtttgtccatgtgtgaatagagggtattagggatgcacaggagtctcctggagttcatctctccaaaccccaggcctttcccaaggaggtgagaggtgtgcctgccccgcgagcggtgcacgtggtccacactccaaggtcccaaacctcttggaatggaagtgatacctttgctcttagagat

SEQ ID NO: 100025 - DNA, 296 bp, Homo sapiens
agctgagagttactggcgatcatgtctgctgaaagaggatgatccacctggagaactctgtttggggccaacagccaggtcttgttaggaactaatgtcgttgatttggggacctatcaactggctccaagcagatgttctaggaacatgggagtaatgttggccccatgtactgagtgggaaggtgacttctgggagagacagaaccctgtaaaaatacaagtgctggcatgtcccagagaaatccagtggtgtcactttctatggatttgcctaaaatttaactcgaggagagg

SEQ ID NO: 100026 - DNA, 335 bp, Homo sapiens
ctgaggttgcctaggttgaatattgtcccctaaactcatgtccactcggaacctcatggaaacacaaactttgcagacgtgatcaagtgaagaggacatcatactgtacagaaagggatgtgcaattttgcccatgggactactctctggagaatccccaggaaaatctcacctgcagctgctggcatcctcctgaagactgtctcattgcaagccactggccactgaacgcagcactgtcctggtctctcctgactggcttgccaaattttgttcctggaccaacctgagggccgagctgctatttctcatggcccagtaacaagaagcagatg

SEQ ID NO: 100027 - DNA, 790 bp, Homo sapiens
tgtgatcttctgcttctggctcccccagcttcaaaggccctgatggtgccccttcccttttggcagcactgtcaggattgagtctctggggactgaggcctccagatacctctgtaccccttgaagctggccctagccacgcctccctaccacagggtctctggaagcttggtcggcagcttcagaagagggaacttggctggtggcctgtgcagcctggcacagaagccacctttgagaaagaggggtgcagagagactcctggcaggtcctcagtgggtggggtagttcctgttctttggaagccacgccggccttgcagcagagcttctgccaccctctccttgggttgtgctgtggtctggacagcaagcagtctctctgtggacagctctgacacatggtccctgcagaggaaaagttgggatctggttgcaaagagagcctagagtgttcttagagaaggacctcagaggagctcttaattagcagaagaaaccctaccacggtttcagggccttctaggattcagattaaagccactgatgacagttcacattttttgtggctccagttaatcaaatattcatcaagcacctatcatggtaaggttctattctggccacggtgaaggaattcaaagaagtatttacaaccattcattcaaccaacatatactgaggatctgctgtacacacaggcaccaagatgtggtccctaccctcagggagctgtttaggttggttggagggaaggaatgtgggtggtgcacagggcctgacacatagaa

SEQ ID NO: 100028 - DNA, 679 bp, Homo sapiens
agtcacagactccacataggccagcaggaaccagagcaaagcacccggagcctcagctgttaaaatgactggtactgggagctggaggtctcactggccgtgactgggtcgaacccagggtgcatctgatgagtgcaggcatggtagactcaggtgacccagaatcttttggttcagggaggtcacatagcccagtaagagccaatgagatgcagcaaaactgctggagatggaaggacaaagacactgaatctttcactctggaattgagcctgagatgtgaaggctggagctgctgcaaccattcctgaagcaagagctctgcatggactctgcctccctctttgtgaggtgggttttgagggagaggaataaaatatgaatgtgtcttcatcaacattttcacctggacatcgtcttctatccattacctctttcaatcccagcaccaacccaggaaagtgggcaaggctgtgtcccctgggagcagaacagagaattggaggaccagcactcgagagctgaacaagcctgcatggccatccatcatagttactaaagagattagactaactctctgtagctccagagggcaaaagaagaaccacttggtagaatccaccagaggcagttttgaattcgaagagaagaagcactttctaatggtcacacagctggc

SEQ ID NO: 100029 - DNA, 414 bp, Homo sapiens
ccggattctgtgcagacccctcttcgctggacacccctttcttggtactctgaggtgaggggtgctgtccacccagagcgcttctccccatagctacgaacgcatccttgattttatgtccttgacttccgtgcatgaggagggggactgcggagtccaccttacttctctctcccattattctcaccccgtctcctgtgaggcgttactgcgtttgttgccaccctcttctcctgtctgacaccttggagccaggatgcgagagctaggagatgaaatggagctcccccccaaccccttcttgtcttgggtggatgccccccatttttcatcctggatctgtatctcatggaagcgggggcactaccagtgccttattaacttggggggagtcagcttctccaccccaccctt

SEQ ID NO: 100030 - DNA, 296 bp, Homo sapiens
acccagcaatccctcttctgcatacatacccaaaggaaatggaatcaccgtcttgtaaagatatctatacttcagtgttcactgaagcattagtcacaatagccaagatattgaaacagcctaagtgtttgtcgatgaggaaattttgtgtataaatacacacacacacacacacacacattttgttcaaaagaataaaatcttgccatttgtcataccatggatatgtctgggacaaattatgctaagtgaataagctagacacagaaagaacaatattgcatgatttcactaat

SEQ ID NO: 100031 - DNA, 360 bp, Homo sapiens
ggagtctggggacccatgagggccagatggatgggctcagatggagtgggaggccattgggaagtggctggtaaaaagcctcatgagggcagagccccactgaccccacacagttacccatggtgtccctttccccacgtggtaattctggactgttcacagtggcttccaaggcctttgggatgggccttgctttctacccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcct

SEQ ID NO: 100032 - DNA, 411 bp, Homo sapiens
gggcagataatgaggtggctggtgtgcagtgacaccgcagggacactgcaaaggtcagagctgagatgagctgccggctctgccatgtgcttactctgagccacctaacctcggcgtgcttcagtttactcatccgctcatctgcagaatgggtgatgctgtcggtacttcgtggcatacaggaaagtgcccagcatggtcagcctcagtgagaggtggccagtggggagtggtggccactgtacacctggcacagcccagagatgcatgtgccactctgttgtgtgcttcaaccaaggggcgctctggcagggcttgggtgggacttcccaaagggcatggaaaagttcccagtcaatgagatccatggagacccatgggagtgggggtcagccccagcctaagaggacc

SEQ ID NO: 100033 - DNA, 289 bp, Homo sapiens
agatgattcattgctgcatgtaagcgagtacaatcagctcaaatatttgtagtcgtcatgcaattgctgtaagaaaacaggggactgtgagccgcagatcgctcccctccccaccagcccctaccctgagccgaggtgtcaggttaaaatgacaggcagctgcctggttcatcctcttctgctttgctgacttagagccacacaaagatccatccccctggagaccagcagcttctgtcaagaagatatttttgtggagagggttatgcccccaacagcctagccagga

SEQ ID NO: 100034 - DNA, 474 bp, Homo sapiens
taccatacatgagtgtggagtagctggagtaaacatactttcaggagccagactttgtgggtttaaatcccagctttgccacttactgtgtgatcttagacaagttacttaacctctctgagccttgggttcatcatctataaaacagaactaataaaagtacctactttacaggattattatgagattaaatactgtatatgaaaagcacttaggccaggcgcggttgctcatgcctgtaatcctagcactttgggaggccgaggcaggtagatcattaagtcgggagttccagaccagactggccaagatggtgaaaccccgtctctactaaaaatacaaaaattagccaggcacggtggccggtgcctgtagtcccagctactcgggagactaaggcagagagttgcttgaacccgggaggcggaggttgctgtgaaccaagattgtactactgcacgccagcctgtctca

SEQ ID NO: 100035 - DNA, 351 bp, Homo sapiens
atcatagcttgcctgtatgttactagagtagttggagagtggaaaagtatctatattctaaagactgtttcatcatttgggtgaaaaaccaaaaaaagagagtaattttgtttaatagctctttcacaaataaaaaaaagaatgttcatctgtagagacctatcgagatctcatcaggtttacaacaaactttagattagcaagctcaatttcagttgacatggattgtggaaagattttcagtggagctcagatatttaatatcctgaatttggatgaatatacaatttctaaaattaagtacttcaactcctctgtggttttaaaaccagtagtggccatatcttgact

SEQ ID NO: 100036 - DNA, 220 bp, Homo sapiens
aaattgtattatattgatattctcagaaaacgtaaggcaagtgcatcagtcagagttctccagggaaacagaaccaataggatatatataccctatgttatatcaggagctttattttaaggaattggcttacaggattgtagaggctggcaggccggcaagtctgaaagccatagggcaggctgacaggttggaaagtcaggcacgagttgctgttact

SEQ ID NO: 100037 - DNA, 571 bp, Homo sapiens
ttttgcggtgccctttccatagctgagactggtttggttttagaaagatgtacatgatctcagagggggtccactgaaaaaagaaaaagaaagaaggatggagagcttgatgctcaccccctcggggagctgcctcactgggggcctgtccgctctgtgcaccttcccaaaccctcattctgtcctgctggcttgcgactctgatcaaccagcagactctggccgctcagcctcctgcatctctgaacccgccccgaacgtctgttcagtacccagatgacttgtgattgtttagtggtgattgacactgcgggatggagggaggaagaccaggcggagctggagggctgggagttcccaggttaccattgaactcactccagaaagagacaggagcaggaagggacgatatggaacagaagcagaatgctgggtgggaacttcaaggtgcttgtgtctgggaaggagacagggaaagaggaaggaggaagaacagtgagaaaccagaattcctttctcttagagatgaaatttaaaggcaggatctcagagccaggaggggacagactca

SEQ ID NO: 100038 - DNA, 227 bp, Homo sapiens
ccttggcttaaatgaaaagatcttgaggacagagaatgtggttcgttcatcccacgattcttagcattgataagagggaaaaaacatgttggaacaaatgaactaatgaataagtgatggactggaaaacagaggcagggtcctatgacgggaaaaggcctggaccagcaggacctgcccacaacctgtgcggtgagtgcccagtgttgtctcggcagcttccatct

SEQ ID NO: 100039 - DNA, 353 bp, Homo sapiens
gtaaatctgaggtcaaggatgtcccatgatggatgatgactgagatggacggaagtttggtttgaagcggtggcattggtgcaggctggcagagggggcagttctggatagagtgtcctgatgaatggggatacccatgggaggtgatgcagatgaggattctgtgcttctgaaggaggagccaggcatttagaatggcactggagagcaaggactgactgagccccttcactgtgtccccaagaggccaggaagggaagattggaggagacaaagttgaagtgagtgttccagggaacgagtcagttaagagatggtaggatcttaagggaagatggctaagatcttaaggg

SEQ ID NO: 100040 - DNA, 749 bp, Homo sapiens
gggtcacatgcttctccccttaatgacggaaacccatgcattctcacacagaaaccacggttttctactttcttcctgcccaaggagagagaagatagcctcaaaaacagacgtagtctctggaaaattgcctgattctctacataaagtgcatgggaaactcaagccatgagtagtgtttgactcaggaactttgagtgtgcaagggcaagcctcaaggccagctgcctatgaagaaataaagatagcctcctcccagtggtctaggtcttgtggtgtccacttgatggaccagccaagactgcctggaatccctactggacacaaacgttggtcatcctatgctggagatttgaagtggtaggtgggagtaccataaatcttcgaaaagtgtgtcagggattctaagttgttttagacaggatatgtcaggtgatgccgcagtaacaacctccaccccttccaaatcttagtgacttaccaaagccaattaatgcctgtttcttattctcgcaaagttcacggtgagtttgggtgactctccaggagagcttttccttgcacagcaaatcaacaatctggaaagcttcaaccttataatacacacatgcttccacagcagggaaatgaagaatggaggatggtgacctggctcttgatttctcctgcctgaagtgacacacatcccatctgcttacataatggtgtccaacttcaagtaatcctcccatattccctgaaggaggggc

SEQ ID NO: 100041 - DNA, 358 bp, Homo sapiens
agctactcgagaggctgaggcaagagaatcgcttgaacccgggagtgggaggctgcagtgagctgggacggagccattgcactccagcctgggcgacaggatgagactccgcctcaaaataatcaaaaattaaaaaataaaagcgcaagccagatgcccaccaccaccctgcctggaaaggacccagcgacctccaccgcccttaaaatctaaggagtctaacgcagccccttattctaagtcacgtgggctacagacaggggctacaccttccaactaagccgcggaaaagtgaacaacggggggcaggttgcaaataagcaaaaacctcaacgtctctggacagttttctgggcgc

SEQ ID NO: 100042 - DNA, 311 bp, Homo sapiens
tctcttgacaggttccctctcagagccctgccaccatgctgtgcaaatcccaagcctcaaggagaggccacatgatggtggctccagcaaataatccctgctgagcctttccttccgccaccccacccaggagccatcagggaaatggatgccccatccaccagccatgggagccgcttctggcagttgaagtcacttcagtggagggccaggcatcatggagcagagagaagctggacctgctgtgtcctgcctgaagtcctagcccacagagctcacaggcacaataaaatggttttggtaatgttgct

SEQ ID NO: 100043 - DNA, 395 bp, Homo sapiens
atggcctcgctgcttgcgagagaaagtggtccctccaagctgagtttggcatgatgacgggcatgagttggccaggtcacaagagcctgagtatctgtgtatagggagaaagccaggagaggtttgaaatggaggctgctggcatttcttcactgccctagtgcacctggagtcttccatgcaccacctctgatccttccagagagtccttcccatttaaccgagagggaaactgaggttcagataatttgcccaggactgcttggctagatggggcagagcctggattcagaagcaggctttctggctcctaaggctgagctttttctacaaaaaaatgttctcgtcgcgccactgcactccagcctgggcaacagattgagactccgactcaa

SEQ ID NO: 100044 - DNA, 743 bp, Homo sapiens
agggacagacggacccggcgggagaggaggaagccgggttgtgggcgcggagctgaggcggaggcggggccggggcgggaaggggcggccccagctgggtcgggcgaggctggctgcgggaaaccgagtgagccctcgcttttcctccggggtccgcgcgcgggaccctatttctggcctgtctcgcgcttcgcctgcgcggtggtctccacgctgggactgcggcgtcctcgcagaacagccagaactccacttcttcctgtccgggaggagttgtttaaaacatgcgtatctccaccttctgcttcttagaacagaactgactgaagccgtgttcttcccgccgagaccatgccgccccatcgaccctgctgcggccagagccacccagggcgggcccactcaccgcaggctcgggccacttggttccaaacctccactcccatccaggggcccggcacacccaccacactcccactctcagaggtctttgccgcctgcttcaggagaaaagagaaacttccactttccaccggcaaaactgcacacctgctccctccatcaccgagcccccccccccaccttctgtttttccagtatcgcagaatccgatccgttgctccctctggactggaatccgtatcctcggcatttcatcattccaagattctctactccacgtacccttgctgccaccctcttctactttccatcgctgaagttggtgaaagaggcgcctgccc

SEQ ID NO: 100045 - DNA, 524 bp, Homo sapiens
atgctatagagagacgactatcattgtgctacatgttttgttgtacgttactgttgagtttttattccagactttcttttgattatttttggtcctgagcaattttaaaaggcacatagtagaaactgctggttgcttagtatccaattacccaccttttctcctccttttttaccccttcttattgtatttaaggtggcagtgtttccagtgatacatttctcagtgttttctgcagttgggtgcaaccattgaaatataagcagaggggccgggcactgtggctcacgcctgtaatcccagcactttgggaggccgaggtgggaggatcatgaggtcaggagatcgagaccatcctggctaatgtggtgaaaccccatttctactaaaaatacaaaaaattagccgggcgtggtggcgggtgcctgtagtcccagctactcaggaggctgaggcaggagaatggcttgaacccatgaggtggagcttgcagtgagccgagatcacaccactgcactccagcc

SEQ ID NO: 100046 - DNA, 279 bp, Homo sapiens
cactgttatgtgaaaagtctgtgctgggtgctaggatacagtggtgaggaagatggacatagttccttcttcctcaaggaacagaggagactttttttattttttttgagacagagtctcgctctgttgcccatgctggagtacaatggtgcgatctcagctcactgcaacctctgcctcccaggagaatcgcttgaactggataggcagaggttgcagtgatccaagaacacaccattgcactccagcctgggcaacaagagtgaaacttcgtctcca

SEQ ID NO: 100047 - DNA, 539 bp, Homo sapiens
ataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagctggacagaaaggaaccaagctaagccttacttcccctggggtttcatgaaatgggagggagctgacaattgcctgagattgaattagctagataagacattgagccccttgctttgcaaaccagactgtttatattccatgtactctctctctgtttatttctcttttgttctttctcagtgtttggaagtgttagaagttccagtctgtctctgctgtattcacgggtgccagaggaaaggctttttgtctagggctttgcttgactgcattaaaggggaggaaggcaatgtggtggac

SEQ ID NO: 100048 - DNA, 462 bp, Homo sapiens
tatattgtccattggaatatacttttaaaaaaattacactaggtttggcctaatcagttcaaacccaaggcagttctctcctaggctcaggagagaaggttagtacgtagagaaagccctggattagggctgtccagaccaggaatactcatgttttaaggccacttctgtcctctttcttacagtgtgaccctggacaagtcattgcttttcttttacctcataattaaaacagtttggataaagtggtctccaaagtatcttctggttctaataatattttgtgaatacataattttctgtagcttgttcattcattcagcaaatatgcacagaggagaagttgtgtgccagcaactctaaggagactgaaagaaaaatcgaatatgtgccatgtgggaagtctcaggccactaagaaagatagacacatgcacagtgacaaatgagtgtgatcagtgct

SEQ ID NO: 100049 - DNA, 392 bp, Homo sapiens
gaaaacagatagaaaccaaggtgctcagcagtgtgaggccaggaagtaggaataataagaacagtcttatagcaaaaacagcatggtcaggcctgtgggtcaggatggatgacttccatgcatccctttcttgctcctcttacccataatttaaagtatcagcacgaagtgtcctgagggggccatcggtcacacacctgtaccctgtgaaggagccaccggggaccgcttggcgtttgttgtggagagctggcacctggattaatagccctacagagaaagtgcccagcaggggagagagaatccccttaaaaaagagcgggctgctattaagattacaggcgtgagcaattgcgcccggtttgaaatggtccctcttcacattctgtctc

SEQ ID NO: 100050 - DNA, 701 bp, Homo sapiens
gttctgctgaacccagaactgaggggatgtgactcttcttctgtcttggtgctgctcgtagaggacattgtgacatctcactgaaccttgcacttagttgatggggaattgtgacatatcacttggcccagtaccaagcaagtgtgactgttctattcatcataagtcctgctttcaagggagattgggacatattgtggggctcaacaccaatgtgacattactgttttgccttggcccagaccttaaaggcactgtgacgtattgctcggctcagcaacaaggtgacgagagatcctgtgtggacattgacaacagagagcattgtgacatatctttgggagcatcagctatttgatgtgactctccttttataccaaggctttgctcataggggagaccgtgatgtatcttctggcccagaaatcaggcgatgtgtttctcctgcctgagctttgctcacagggagcattgtgacatatcactgagcccagcacccaggtgatgggactctactgcctgtcccctgctttcaggaggaaattgtaacatatctctgaccaagcacccaggtgataagtcttctgcctggtgcctgttctcagggaagattgtgacatatccctggcccagcaaccagatgatgcagatgacgtatctctcctgctcactctctatccacaggtaagattatgacatat

SEQ ID NO: 100051 - DNA, 752 bp, Homo sapiens
agcggaactgaggttaagcaaaagcacggaatcatgaaaattattctttgaaatggcaaagatttctgtggctggatcatgggatttattgactggagcgatttctcctcagaagaccagacacatgcagcataaatactttttggagaaaaacactatgaggagcattgagaaagtcctcatttggaatacttagctggacttacctaaactgaactttcccttccttgacccagggcaacctctgccaagcccaccaccctccagctcctacgccatgaaagatcgaagaagataatcagaaaaaccacccaagaaaaggaaaagggagaatcagttacatatccagcaagccagaaaacaagaaaacccaaatctgttccagttctctagtttcaccttaaaggcaaagaactgtagatgcttgtgaggagctcttcaaagcctaaattcatagcctctctacgcgggaggttaccagcatctgaagaaaaacaaccactaccagaaaagctcttctttgttttcattcttcgcagtccttcaggaaactcttgataatgtgaaatgttattactgcaaatgttggctcaagcacgtttactctagagtctgactatcagtgacttgttcgcaaaataaaatcatttttaaagcctacaaggaaagccaagagcaaaccacaaatcagaaaaccaccaaggcgggctggcctcattgccagaatttaatgtgatctaatgcgaggacaa

SEQ ID NO: 100052 - DNA, 440 bp, Homo sapiens
aagattattagcaatttgagaatttcccgtgcatattggagatgagcaaatggaataagtgctcatgtgtagcgacaggattctctattttatttcaatacttaatattgtaccaaaccaagtaagaggagcatcatgagaaaatgtactaaaggacagtcattacctatatttacacctagaaaagaaaactatattattgataaactgataaatctattttatgtatttattattttgctctgtcatccaggctggagtgtactggtgcgatttccactcattgcaacctcttgctcccaggttcaagcaattctacctcagctcccagctactctggaggctgagacatgagaatggcataaacccgggaggcagagcttgcagtgagccaagatggtgccactgcactccagcctgggcgacagagctagactccg

SEQ ID NO: 100053 - DNA, 730 bp, Homo sapiens
gacagctccagggtttcctgaggaaggcaccatccaccttcatccacctcaggcgtgtcctgcagatccctctggagaaccagcttcaggttctgccaattttgatgctgcctaacgaaacccatgaagaagtaaatgatggggttggcactgctgttaagagacgacaggaaaatggaaggcagatgaacatgagaatataagacttcccagtccatgtggatcctggaaaacagggcccactgaatgccaatgggcaggccgcagaggaggaagaccagcactgtgagcagatggtcatgtacagcctggtcagcggcatcttctgggatccacagaggatcctgaccactaggaccaggctggacacacagagaaccacaaataaaaaaatcagccacgtaactgtgatgaatctgatgtttgacaccaaacagaatcagcatcactaaacagggagtcacagaacatccactccaggatgctctacagcagggacagggcccagagcaggacacacacgaccgttgacaggtgtgtggggtggcggcagcgttaccagatgggccacaggattgacaggcagcgcttggtgctcatggcactcagaatattcaggcctgccaagtagggaaaggtcatcacaggctagaggattagagagatgggatggacgttattgatgaggtgtaacagggatgtataatgtggctgctgaggaggaggaagt

SEQ ID NO: 100054 - DNA, 847 bp, Homo sapiens
gaggggcaatccaaacttataaactggatacattacagagcactgtcattttccatctcagccaatctggttcttattcactgactgtaattacaaatgtaggtgtatgaattagttggttaaaaactccaaagtgtgtgtgcacataagtgcattacatgtaaatactctgagtgcagaatacctaatttaaatgagtgacagggagcacaacatcattggaattgtcagggaaacagaaattaggtgttttacagccccgtctttgtctctggatactgcattcatgtattagaacccagaggagcttcaaaatatgtacagaattgagtgggatcttgggtgtaacctattaccatgagaaattggcaagaaggaaatcacttgttttctgcatgttcttatgtaaccttgaacaaactgttctgttaaaaaaaaaaaaagtctttttccttgcttaaaaaaaaaatcagcttagccttccagatattttcaatagctgcacttgttagtatgccatctttttttttttaaaaactgcctgtctttttttctccttacaacttcctaagttaagcctcaagtgagaatctcagcaaattgacttttagtaatattttaattattgagattattacggtgtggtccagtgtggtgaatcctatagtcgttttactcgtgtattctaatgtcaacaggattgtgctagtttagatgccctgtttgcgtctaatcattttatgtcgaaaatagatgggggagaggtcaaggacgtagtctgtgaaaacaatgtgaaccgggacctctgatcttcattcctgttccctttttctcccaacttatttgt

SEQ ID NO: 100055 - DNA, 807 bp, Homo sapiens
tctggatctttgttatcagaaaaaaaaatgtgtgtttgtgtgtgtttctctaatatgatcttcccaaaactcctatcttttaggaggttttcttagttggagccaatgggttaccactgttatctccatagcacgtattctcatgttttccctacattgcttcaggcgaacttgttaattatgttcacagtgctctcctggttctgtcgtgcaacttgttctgcttcttcctcagtgcctcctctacagggctctgcacacagtgggctgttaaatacaatagatgctttacatttgctggtatggagttcaggctcaattattcacaagtatttgacatgtcacaataaatagttttcctggacgtgaattttaattcacccagatgctaggtcttctcacaaagctaatgagtgacatagcccatagcccaggatctcagcttcacttggatactttttgtttgtttgttttgttttgagacaaggcctcactctgtcacccaggctgaagtgcagtggcacaaacacagctcactgcagcctcgacctcttgtgctcaagtgatcctcctgcctcggctttccatgtagcatggatcacaggtgcccaccaccatgcccagctaacttcttaaaaattattttgtagagatggggtctgccatgttgcccagactggtcttgaactcctgggctcaagtgattctcctgcctccagagtgctgggattacaggtgtgagccactgtgcccagccctatatatgtgttagttcttgagaggtgattaaaatttagtttctttttt

SEQ ID NO: 100056 - DNA, 238 bp, Homo sapiens
tcaatcaaaaagtttttagtagcttcagtaggtctgaaatttcagagtattgagcaaggcctacactgagctagagcatgatctaataagattggactgtcaaaacaagaagcaccagtctgtggtcaaaaggtttttaagaaggaaatgttaaagctctgctgtgagaaactcaagatcatgaaacatgtaagctggcaggctgtttctttctcatttctactatgatggggggacc

SEQ ID NO: 100057 - DNA, 429 bp, Homo sapiens
atttctgaagtcagtggatatatcatatattggacagttgaatcacttttatattagtttgctcaaaaacatttattaagctcattctccatgccaagcatcatgtttggtgctaagattacatctttgaacaaactgtcctcatattgttcaggaaaacccctaagtagataggcagccatatatggtagaagacaggaactgtgacaagaaatatatttttataaatcccacattgagagttcagctggcagtaaataggagtagggtggggtttgtgcaggttaaagtctataaaatgccatggcaagaggttgaattagagcctgattatgaagttaggaggcccaaaacacagtgggcacatattcacagatcttgttgaggaacagatggagggatcaactgtgttcactgccctttatttat

SEQ ID NO: 100058 - DNA, 3563 bp, Homo sapiens
gcagtttgttgccttctttgccaattccccttcccggcccctcctccaggtgcctttgtgtctcccggggtgccactgacagaacctcacctggggctcctcccatggcagtgccatgtggtccaaaattgccctttccttctccgttagtcacatttcccataactcctccgagccaacataacctacagtaagatgtgagtgtcagacgttctctccctggagtctgctttccaaaggaggcagggtgagtagatttcttgatccaaaggaatccgtttttaatttttttttttttctagagatgggggtctcactatgttgcccaggctggcctcgaactcctgagtttaagtgattctcccacctcagcctcctgagtagctgagaatccctttttagggtacaatttcaggcagtgtggcatggagtcagaagcaggctgtttctcctcaggggagggcaggcttctcaggacggcctcagctcatagccccacgtgtggtgtgcacggatgtgcagggagagcctgattgttaggtggatgtattttccagaatcggggagggactgaacacgagcatttcccattaatatgtgcaataaatgtcttggggaaggggctatttgaccctcattcccatagttttggcacttcaaatgaagctcttccttgtggtcaccatctctgctgtgggcacacagcttctttttcttggtttttttttttttttttttttttgagacaccgtctcgctctgtcacccaggctggagtacaatggtgtgacctcaactcactgtgacttccgcctcctgggttcaagtgattctcctgcctcagcctcctgagtagctgggattacaggcgtgcaccaccacgcctggcgaattttgtgtttttagtagacatgaggtttcaccgtgttggccaggctggtctggaactcctgatctcaagtgatccgcccgcctcagcctctcaaagtgctgggattacaggcgtgagccactgcgcctgcttggcacgtggcttctgaatggcctgagtgagggcagggcccaggcatggaggctcctgcacccccaaggctttttggctgtgctttatggcctctggcttatactcaacccaattttacaagcatgaacttagacttctctttagtatttatatatttaaaaaccaagtttaaattaactcaaacttgacagcaactaacctctgaaagaaactttaaagaaaattgaaatcttgagccacaaacatgttctttcctcactagctcctcccaggttttatcctgcacccagcttggatgagagacccactgtttcttgtgcctacttaacattagggttccccgtggcagcttcatcctgagcactgcctgtgagccctggttctgggacttggcagtcgcctccctggagcatctttccagagccagcattagaacctgagatccccagatgtttctgcccctcatccccatcctgtgaatagagagacagaaaaggtgcaggttcccattctgcatagattctgctgtttcctctccaccggtcccaggcagcttttcctttccatcactgccgcttagcaaaaatgtgcttcttttgaagaactggtcattttttttgagtgccctcttctcagttttgtttaaacttacactcagtagagtgttgggttgtctgctgacatggagtagaacctggattctggccaaataggccagaatcggaaaggtgaaggtgagtgtgatagtaggtaatctcctcaccccagcacaggccctgggagagaggcaaagcagtttgatgggatctggaggggagggaggtaccctggcccttggtctagcatcagtgagtcctgcccttccaagcccctggaggctagtggcattgcattgtgcccctttttgccacccttctctgatgtgattttgagcgaagaggagtcagtaagcccattgagaccggctgctcccaaagcccgaggactctagctgtgtggggaagggctagcattggtcaggactctgctgacagcactgagtaggcaggaatgtatttgagatttggaagtactgttaatttggtggagtcaggtgaatggataagaggcagatcggcagaaagcatcagtgtggtcccgaggctccctctgttttccttgccatggagtccccagcgccttgtgcctgtttccatttccctctctctttgaaaagtagaaatcagtggtttcttgactcctaaacagcctcctcactatagaaggagcctgagcaggtcagaagaactagaaaagtcctcagatacccccctctgtccagccccctttcccatacacagatatcaatggatgagcaggaaaagaggaggcctggactcactgaagtacttgaagaagcacaagtgtcatagatgtgccgccctttgccctgggtgttctagatcacacagaacacgtttcagctgggactaagaatcagactagccaggggttcttctgaacagctcaggccagacctctgggctcctctgggggccctgggacatgatgccttgcagtttccattccattgtccccaggcctcctgacctggtgacagagagtgccctgcagaagtgagtctatttttcccaattcctcttcatgaccagaaaatggcagctggccggttggggtcctgtgggaaagggctaacctgggctgttaggtagacactaggtttaaaggtagacagggagatggcatcatcagggcaggccaggcccacttcctgtgaccccagaccttggcaggcgggtcgtgctgaaaccaggcatctccctcacacctggggaaaggtttagggcaacatgttgcctcttcatcccattaaccctagaaatcttctggttagagtggccccttaccccaaatctggcctaggtctgaagactgcaggatagtcatgatgggcccatcctagagcctggctagctggaagacgcggtatggcagggacaggagggcggcaggaagggctttgtggccctgctggggccaaaggcagttttctgtgctccctttagccccagcctggctggccaggtctcctgtacttcaggggaccatggggccgcccaagccagtcaccttccccttccaagctctccccccatgactgttgatttctggcgcgtggaggcagagttgtgaatccacaaatgctgtagcccatatctcgtaatgtgtctgtgtccacttagagcctcacgacctggctgtgtgtgtgcatgtgtgtgtagtatagtttgtagttgacaatatgtgtatataatagctggtgtatttatatgtgagtgcagaattagtgcccgtggcggttttctgtattttaaacccattgaattggttagttttattttagggaagtgggaaaggcggagtggggggaagtataggaagaaggattcttagcaaaatcattctctaggactattagtcgcgatctcccagtgagccatcacgatgcccttttcaaataaatgttaatgttgtcacca

SEQ ID NO: 100059 - DNA, 3808 bp, Homo sapiens
gcagtttgttgccttctttgccaattccccttcccggcccctcctccaggtgcctttgtgtctcccggggtgccactgacagaacctcacctggggctcctcccatggcagtgccatgtggtccaaaattgccctttccttctccgttagtcacatttcccataactcctccgagccaacataacctacagtaagatgtgagtgtcagacgttctctccctggagtctgctttccaaaggaggcagggtgagtagatttcttgatccaaaggaatccgtttttaatttttttttttttctagagatgggggtctcactatgttgcccaggctggcctcgaactcctgagtttaagtgattctcccacctcagcctcctgagtagctgagaatccctttttagggtacaatttcaggcagtgtggcatggagtcagaagcaggctgtttctcctcaggggagggcaggcttctcaggacggcctcagctcatagccccacgtgtggtgtgcacggatgtgcagggagagcctgattgttaggtggatgtattttccagaatcggggagggactgaacacgagcatttcccattaatatgtgcaataaatgtcttggggaaggggctatttgaccctcattcccatagttttggcacttcaaatgaagctcttccttgtggtcaccatctctgctgtgggcacacagcttctttttcttggtttttttttttttttttttttttgagacaccgtctcgctctgtcacccaggctggagtacaatggtgtgacctcaactcactgtgacttccgcctcctgggttcaagtgattctcctgcctcagcctcctgagtagctgggattacaggcgtgcaccaccacgcctggcgaattttgtgtttttagtagacatgaggtttcaccgtgttggccaggctggtctggaactcctgatctcaagtgatccgcccgcctcagcctctcaaagtgctgggattacaggcgtgagccactgcgcctgcttggcacgtggcttctgaatggcctgagtgagggcagggcccaggcatggaggctcctgcacccccaaggctttttggctgtgctttatggcctctggcttatactcaacccaattttacaagcatgaacttagacttctctttagtatttatatatttaaaaaccaagtttaaattaactcaaacttgacagcaactaacctctgaaagaaactttaaagaaaattgaaatcttgagccacaaacatgttctttcctcactagctcctcccaggttttatcctgcacccagcttggatgagagacccactgtttcttgtgcctacttaacattagggttccccgtggcagcttcatcctgagcactgcctgtgagccctggttctgggacttggcagtcgcctccctggagcatctttccagagccagcattagaacctgagatccccagatgtttctgcccctcatccccatcctgtgaatagagagacagaaaaggtgcaggttcccattctgcatagattctgctgtttcctctccaccggtcccaggcagcttttcctttccatcactgccgcttagcaaaaatgtgcttcttttgaagaactggtcattttttttgagtgccctcttctcagttttgtttaaacttacactcagtagagtgttgggttgtctgctgacatggagtagaacctggattctggccaaataggccagaatcggaaaggtgaaggtgagtgtgatagtaggtaatctcctcaccccagcacaggccctgggagagaggcaaagcagtttgatgggatctggaggggagggaggtaccctggcccttggtctagcatcagtgagtcctgcccttccaagcccctggaggctagtggcattgcattgtgcccctttttgccacccttctctgatgtgattttgagcgaagaggagtcagtaagcccattgagaccggctgctcccaaagcccgaggactctagctgtgtggggaagggctagcattggtcaggactctgctgacagcactgagtaggcaggaatgtatttgagatttggaagtactgttaatttggtggagtcaggtgaatggataagaggcagatcggcagaaagcatcagtgtggtcccgaggctccctctgttttccttgccatggagtccccagcgccttgtgcctgtttccatttccctctctctttgaaaagtagaaatcagtggtttcttgactcctaaacagcctcctcactatagaaggagcctgagcaggtcagaagaactagaaaagtcctcagatacccccctctgtccagccccctttcccatacacagatatcaatggatgagcaggaaaagaggaggcctggactcactgaagtacttgaagaagcacaagtgtcatagatgtgccgccctttgccctgggtgttctagatcacacagaacacgtttcagctgggactaagaatcagactagccaggggttcttctgaacagctcaggccagacctctgggctcctctgggggccctgggacatgatgccttgcagtttccattccattgtccccaggcctcctgacctggtgacagagagtgccctgcagaagtgagtctatttttcccaattcctcttcatgaccagaaaatggcagctggccggttggggtcctgtgggaaagggctaacctgggctgttaggtagacactaggtttaaaggtagacagggagatggcatcatcagggcaggccaggcccacttcctgtgaccccagaccttggcaggcgggtcgtgctgaaaccaggcatctccctcacacctggggaaaggtttagggcaacatgttgcctcttcatcccattaaccctagaaatcttctggttagagtggccccttaccccaaatctggcctaggtctgaagactgcaggatagtcatgatgggcccatcctagagcctggctagctggaagacgcggtatggcagggacaggagggcggcaggaagggctttgtggccctgctggggccaaaggcagttttctgtgctccctttagccccagcctggctggccaggtctcctgtacttcaggggaccatggggccgcccaagccagtcaccttccccttccaagctctccccccatgactgttgatttctggcgcgtggaggcagagttgtgaatccacaaatgctgtagcccatatctcgtaatgtgtctgtgtccacttagagcctcacgacctggctgtgtgtgtgcatgtgtgtgtagtatagtttgtagttgacaatatgtgtatataatagctggtgtatttatatgtgagtgcagaattagtgcccgtggcggttttctgtattttaaacccattgaattggttagttttattttagggaagtgggaaaggcggagtggggggaagtataggaagaaggattcttagcaaaatcattctctaggactattagtcgcgatctcccagtgagccatcacgatgcccttttcaaataaatgttaatgttgtcaccaaaaaaaaaaagctccggattatttcagggccgaaacagggcatgaatggccagtgcctacgggttctgcacccgattttgttcaagggaactgcggccctatgaaagagaattgaacaggtcacatcatgattgcccgcttacaatatctgccatgcgtgcagagacaacttcctaagagcgagagacagcacttcgtctatgaccatcacatcaccaccagagctacagttgagacatatatga

SEQ ID NO: 100060 - DNA, 292 bp, Homo sapiens
tacgggaagccaccaccccaaaaaaataaagccagaacaagtaacacagggcttaataactgcacatatgaaaaagaccaagggatttggttgattacaacctagaaattcatgtggttggaggggtcatcctgctgctcagatgtgggtggctcagaacagccaatggctggtgctgtctgcctgtgagtggacatctgcagctcacattctaaacctgagactgacaagctggcgccagtgccaggtcacctgaggagcatgtaaagagacgctgggccttgagctatcc

SEQ ID NO: 100061 - DNA, 243 bp, Homo sapiens
gaatgttctctcttactacttcatattcaacccctgcctcttctccacaccctagtaaccacagttctaaattcttttgacacctaggtgactacctgttctagaacttactataaatacagtcatatattatgtactctattgtgttcttatgctattttatgaaattatgttttgttgtatatatggattatttgtttcttattaaaatgctgaatagtattcccttatatgaatccaatc

SEQ ID NO: 100062 - DNA, 283 bp, Homo sapiens
ccaggcccaggggcgcctttctcagcatcttcccgcggaggctggtgggggcgggatggggggaagaggacgaacgcctagcgcccagggtagggcctccaggggtagggtggccaggaggaggcggagagacttgaccttgggaggcctgacttactgaccgcaggggcagcggactgggaggggaacgtggcaagcccgggactgggccgggggcgaggctgggggcgtgtcttgggctggagagggggagatcggccctcggacttcctggtcgggcccc

SEQ ID NO: 100063 - DNA, 434 bp, Homo sapiens
agcgtctgagttattttgaaaccagtgcagtaatcaggtgtctgagccctttaggtcagctaattagtggcaaactttaaaaaagaaatgttttaagtattgaaatttgtctttctaacaaaatgttactcagaaatgcaacacataagacagaaaaagcagagccactctggttagactatggatggacaggagagaacagagtgccacagtgccatcctcacctctaggccatgcccgggagatcccaacagttctaaggacatagatgaaagccacctatgaggtccaacttcattatacactcgtggcaactcacaagatccagagatgagtggtgtggccacctgtttttcctgattactggaccgatgctcttctgcagtgccaggtcccttcccctcttccacactccccacacatctcataacaaa

SEQ ID NO: 100064 - DNA, 241 bp, Homo sapiens
gacggtaaatgcaagccaggatctgaaggtggtggcaggctgacctgggctctgtcccccaccgcgaagctctactacccccagcctggcactgtctctctccctcccctgactttcccacccccatcccccaagggcttcagagacttccagatcctctaatcctgtcccagaaagaaatgaaaaaaatatgtggtcttgcaacatttctttttttatactgtaagttctagggtacatg

SEQ ID NO: 100065 - DNA, 322 bp, Homo sapiens
gcatcctccttggcttagctctcaccctacttattctcttgttgcagaggttctcaactctggccacccattagagtcccctgggaagcattgaaaaatactgatccctggccaggtgtgatggctcacacttataatcccagcacttgagaggccgaggcgggtggattgcatgaggccaggagtttgagaccagcttggccaacatggtgaaaccccttctctactaaaactacaaaaattagccaggcatggtggcaggtgcctctaatcccagctactcaggaggctgaagaaggagaattgcttgaacccaggaggc

SEQ ID NO: 100066 - DNA, 337 bp, Homo sapiens
ttccttccccgctccatcaagatgactcctctgctactgttcatggcttcctacccaccccgaatacaaacttcaaactccttccttttgccacaaagcccctcacgaccttgcttgatgcgttctcctggttctctccgatcctgccccattgagtcacttccagtttttctaaaatggcttcaagctcccattcaccccatcaggaaaacgaaaggattttctctgtttgttttcttccctgctttaccccagtgtctacaacaatgccaggtacataataagttcgcaaacatgacaataaaaggcctctggatctttattattaatattattt

SEQ ID NO: 100067 - DNA, 200 bp, Homo sapiens
aagcatattaataagggataggtaacaagtgtacatattacagacaaagactagctaaaatatagactagttatataacgtgatcagaaacaaatgtactttcattgattatactacatttcaaacacatcagagcactatctcagagtaaggtggtgaaattttataaaagtatattcactaaatgaaaattcataaat

SEQ ID NO: 100068 - DNA, 253 bp, Homo sapiens
aaattagtgatgtgcactacataatttatattagaaagcatgcccccttgacttgtagtggtaataaggggcagataaaatattcccaagctcagcagcatgaaaaagcaatcaaaggaattcagctgaaaacgaaatccttagatacatcaaaagcatcccttcaggagaggtgagcttgctgtccagacagaacactctcaccagacttgcattatggtatttgagtgtattttgccctgtaattggatag

SEQ ID NO: 100069 - DNA, 651 bp, Homo sapiens
ctttcagcttttgcacttgcttcctacatcgctgagcaaattgaagcaatcaaatgagagcttccagaaactccactgcatctattagtctactcaatctgtgttcttatgatctttatccactggaaggtacaatcttaaggttaaaacctacattcctaaataaactcatctgtttttctccactcaaaggcctggccagaacttccaaaactatgttgaaaaagagccaatatagccaagatgatcctaagcaaaaagaacaaagctggaggcattatgctgtctgacttcaaattatactacaaggaagtcagggactctgaacggagggaccaactggagctgcagcagaggaacataaattgtgaagatttcatggacattcaccagtttccaaataatactcttataatttcttacacctgtcttaatttaatctcttaatcctgttatctttgtaagctgaggatgtacatcacctcaggaccactgtgataattgtgttaactgtacaaattgattgtaaaacatgtgtgtttgaacaatatgaaatcagttcaccttgaaaaagaacagaataacagcgattttcagggaacaagggaagacaaccataaggtctgactgcctgtgaggtcgggcaaaaca

SEQ ID NO: 100070 - DNA, 2754 bp, Homo sapiens
ctgtttgctaaaggcatgcgggctacagcattcaagagagggagtcgttaacaaagggaaagagataaatgtaaataagctcacatttacagaatgagcggtttgcagtaaaaagctgcggcagcccagagtctgctactttaggctgggctaacctttccctgtaaaaaaaaaaaaaaaaaaaaaaaaaaaaaaatggataaaaatatgcacttccaaagggcgagttgcccatttacatgtttattagctaattatctacaggcatcagcacattctctcatctagcacactctttcttggggaagacagatttctggaggagtgtgaaaatcaactctccttaatattaagcacccattggaggaaatctctaactacagtgcctccaggaaactcattggttattccagtcttagataaaattggtgccaggatttggttcgaactaatgtggaggaaaatatttcctaccggtccatagtgtcagagtggtgaacccctgcagccagcaggcctcctgaaaaaaaagtccatgggtgacagaagattcattgacttccaattccaagattcaaattcaagcctcagacccaggttgggcaatgctactgccaataatacttgcattgttgatgattccttcaagtataatctcaatggtgctgtctacagtgttgtattcatcttgggtctgataaccaacagtgtctctctgtttgtcttctgtttccgcatgaaaatgagaagtgagactgctatttttatcaccaatctagctgtctctgatttgctttttgtctgtacactaccttttaaaatattttacaacttcaaccgccactggccttttggtgacaccctctgcaagatctctggaactgcattccttaccaacatctatgggagcatgctctttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcttctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttaggtatgagaaatgtgttcaggtccagatatggtttctcctataatttttcctatgctataaactaaagatttgaagctaatgatactgagaataatgcaccaaatccagtcagatacatttgtttgaaggtatactgtagagtttttattgctgttttgttcagtaattataggtcaaatctaattacaacaaccaagatggattgccaaactcttctgcttggttggaatttcattgtatcgcattatccaggtggctagtggcatttgataatatagagatgactttgaaactttcaaaaaggtatttctattccaatgatatttggtaattaggttgggcctataaatatagaacaaattcagggatttttaaaaaattgtgttactactgatatatgctagttttattttatttttttgaactgtcattgagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagctgctaaatacgtgtctggcaggtaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggtcaggagcaaattgaaaaaaaaaataaagtaatacaaaaaaatcaaactataaagcaaaaacatttattaaaacctgaattaatcctttttggagggaggagtagagatatataacctgaaaatacttattctttcttatcgaattttggagcctaatatagccaggagctgctgaatttgtgcccctggattggaagcaaataaaaaaaaa

SEQ ID NO: 100071 - DNA, 446 bp, Homo sapiens
  misc_feature (241)..(241): n is a, c, g, or t
  misc_feature (251)..(251): n is a, c, g, or t
cgagtaaatcagtgaaggggtatgagcccgcattgccaggagatcccttgcatcagttgtcgcattgaatgtgaatcctaacggagtagtatatgggtaaccatatgtaagctgttagcagagcaacaagaaagtatacctcctgtcaacagctaccgaatgactcaagttatgcacagaagtatgcatgtcgtgagcgagatagagatatagagagagagagagagagagagagagaganagagagaganagagagagagagagagagagagagagaggcaagttaaagggagaaccaggaagatgcctcacagaaacattcaggccaagcttagctaaagcttgatctattcaattgccttttgggaaaatgcagtgagaattgttgcccttgctgtggtttgttcagcgcctaattgtgtagctaccttttgtatgtgatgat

SEQ ID NO: 100072 - DNA, 314 bp, Homo sapiens
tctctgatcttacatttccctctgacttgaagttgatctgttagcatctcttttagtgtgggtctgctgtttattatttatttacctgaattatctttattttgccttccatagtaaagggtattttatctggatataagactttatgttggcagttgttttcttttagcacgttgaaaatatgattccactgttttctggctttcattgttgtatatgagaagtcagctgtcagtctacttgcaatgcccctaatggtaacctgtttttttctttttaagattgtctccttgtgaataatttgtgcagcagca

SEQ ID NO: 100073 - DNA, 120 bp, Homo sapiens
caggtgaagacattgaaatagccatggataacttgagctgtccaggagccaggatgaggactcagctccacaaaatccaaatgccttcattatattaaactgcctatatgaatgactgct

SEQ ID NO: 100074 - DNA, 338 bp, Homo sapiens
tagctggaattacaggtgcccgccaccacgtccggctaatttttgtatttttagaagggacagggtttcaccatattgctcaggctggtctggaactcctgacctcaggtgatgcacccacctcggcctcccaaagacacatgggtaattttatattttctttttcttttctttctttctttctctccttccttccttccttccttcttgcttgcttctttccttttttttttcttttctttcgaggtggggccccactctgtcatgcacctggagtgcaatggcacaatcatagctcactgctgcctcaaactcttggacttaagcaatcctcccac

SEQ ID NO: 100075 - DNA, 781 bp, Homo sapiens
gctgggctcctgggttgcagaatttaaggcagcattcaccctcaggaccaggcaagtgcagagtcagcagtcctgttcctgggtatggagtcctgtcctgcccccgtacccagcttcattctcctttgagatttcatttgtcacaaaagcctttcactaggtgatgaccaagctccaaaggtgaccccaggtaacccacgaggggcctccgcacaccctcacatcacctccccaccatgtccaagctttgtatgtagcaaaagtctgtgaaagacagcgtgggagggaagtgagactctccacattttcaggaataaaaagtacatttttacacttacttgattacttaaaggccccatctatcgcaaatgttgcctggccttccggtggcacacgcccggggcttccagtgtttcgatataaacccagacccttaagaagatgtaatcgccggttgtcttacaagcagtcatctcatcacaggggggttggaaggagaattcaggagccaaacagccgcaagagcacctggcagatccagttccgctggatgatgtctttgaacaagactaaaaatgactgtgtcgatggcttcgccgttttccaacatttggtggaatgacagagccttaggacatgtctgtagccacaatctgccatctctgacatcaactgagtgttactaattcccattcctctcttttaatgaaggaagagttcatcagtgctggtctcatccaaagaagcaaattagggagtctgttctttgcaaatgttgggg

SEQ ID NO: 100076 - DNA, 367 bp, Homo sapiens
tgttcttaggcccgttttactgatggggatgcgaaggccctaagaggagaagcagtttgcccagggtcacagagcaagttcatgattctcaacaaagggcttctactgcttcacaggctcaggatttcttttttttttttgagacggagtcactctgctgcccaggctggagtgcagtggcgtgatctcggcttactgcaagcgccgcctgctgggctcacgccattgtcctgcctcagcctcccgagtagctaggactacaggcacccggcaccatgcccggctaattttttgtatttttagtagatacagggtttcactgtgttcaccaggatggtctcgatctcctgaccttgtgatccacccg

SEQ ID NO: 100077 - DNA, 850 bp, Homo sapiens
ctgcattagacacacacataaggatttatagggaaccaaaagggcattctctaagcagcgtctcaaaagataccattgaacatagctaagaatatccaccacaggggccctggtctcactttgttgatgagtgttatagagcaaaatgattaaattgaaactttgacagtttaatactctatgggtatattaatggcatgcttgttgctacattcatttcaaaatgaaagttgaaaagctttattaaatgaagtgagaagattctgtgcatttgacctagtgctactaggtggttcagagggtgacaatggggtgccccatatgataaatgaaacgtctatgaggataaactaagagattgtaaatgtagaactgagtgtgagggagatcacttaaaactctagtcaaggtgacctgggtataatctcaaagagaggattggagtgtggctgaaaaaatgatacttgttattacatgtaccagacattattcttaggactactttcagaagtaggtatttttattgttccctttttgtagatgaaaaaataggcttaaagaggttaagtgtaacttgcttaagatcacacacacagagtaagtggcagtactatctggttgcagagctcatgctctttcccattcaagcttatacagtcttagagaggtttgagtaagtaggaacttaactaattgtgatgtactttgtctggaaaaagaatttgaatagatattctcagtccagcgcataggagaggaaagcccaaagagctgttctcagtacctaccgcactacctgctgcacatcacagaaagggctaaatctggcaaacacagatgtagaccccag

SEQ ID NO: 100078 - DNA, 395 bp, Homo sapiens
gggtgcatgttatttttagtaatgttaacagtagcaaaaacaaaaacaaacctttgtaggtaatatctaaaatcccattagttgagaatgttactttatgatgtaggatcctttgatctgtgggtataacagccatcaagccacaatgaaattcagcatcccgctgggggaaggcaaactttaaactttagaaatcaaacagttttttcatttaagagggagaaactaaagtaaaaatgtcacatctgtcaagaaaaataaagttaaaaaaagtttgaaaagccagtaatttataataattttgaagtctactgaaacataccttgacaacatccagattaaatgtatatcaaatgaagcattctgaaatcaccacacagaaaggttaaaagttt

SEQ ID NO: 100079 - DNA, 612 bp, Homo sapiens
ccccattgttctgcagccagagagaactgtcttggtgttggaggaatgattctggcctagggtgaggatatttagttttacaacttgtgggactgtgacttaatttacccctttattggtttgtactcttggttgtaaatttcagaaattcagcccaaatcacttaagctccaaaagaaaaaggaaaaagaaaaaatgccagtggggtcacaggtacgcagctggatccaggggcttggaccttatctttcaggtcctctttcccttttctacccctctgtgttggcctcatacacaggcctgttatcttttcagcctagagattcccagcctagaaagagggctttttgccctggtggttgcagcaagtctcagaattgagcttcattggttcagcctgagtcacacgcccattgctgaaccaatcactgtgatgtaggggttccagtatgcagattggccaggcccagagcatagggtgggccctctgctttcttctcccaaacctccagatagagaaccaaggagggttattccttgagggccaattgagggggctcctacccaacaaaggagggtgggttcccagtggcagaaatgactgacgcccac

SEQ ID NO: 100080 - DNA, 307 bp, Homo sapiens
agtattcaaatatgaacttgtttctgaagttagagtctaacaaactttttagccactgtatataaagaaatcagctagcggatagaaaatacattagagataaggtttactatggaattgtctcatagaacctaagagaggaatttaattttttatttaatttagaaaagaaataaaactgatatttccaattattagtgattcacccctaattatgacatttgagattttgttctgaagttaattgattttaaaggttgacaagagactttatatatacctatgcttaacaattctttgggatttc

SEQ ID NO: 100081 - DNA, 324 bp, Homo sapiens
ctaacagaccctgcgattctacatgtatgtggaaacaacgttttatcaagagatcattcataataaaggaggcttcactaaagaaacggctaaagttttttcttttgtgcataacagccaaaacaatgaaaatttaagctctacagatattctaatatgcactgtaaaagtgtgtcccatttagtattttattttattttttatttttatttatttatttatttttgagacagagtctcactctgtcacccaggctggagtgcagtggccacatctcggctcactgcaacctccacctagcaggttcaagcgattctcctgcct

SEQ ID NO: 100082 - DNA, 255 bp, Homo sapiens
tactactaaattcgcggccgcgtcgactttttttttgcagtggattaaaccattaaaaaattgaaaaagaaaagttgaaagtagagcttggatcttgaatttctctgagtaatgaacagttattgagactccaggccatggggtgatattcagaaatcctgttacatccacctgtcaggtaagaaagccccagctccaaaaccaaatatgggattcttcactcatctgggttagggttctcaatcttggccctat

SEQ ID NO: 100083 - DNA, 386 bp, Homo sapiens
tactccacaagtttcttttgaccatcagaggttataattgagaacatattcaaggttgtactgggttttagttagaaattcagaggacaatttggacagatcccctgctttgcctctgttgcttccttgccctcttccccatcccattccccagttaataactcccaggagtgggtggtaagggggatggctatgggccaggatggagcaggagctctgggcctcacttccgttctacaagccagggaagccacagcttcttcctgcctctacgttcccacatccctggcagttgtaacttcagacagacctctggatttttactaagttttcattcaagacccttcatcatttggctccaacttacctttccaggctttccttct

SEQ ID NO: 100084 - DNA, 369 bp, Homo sapiens
ggctttgttcatttttcttcattttgtctcctcctcagactgggtaatatcatttgtcctatcttcgagttcactaattctttcttctgcctgatcaaatatcctattgaacctctgtaatacatatttaatttcagctattatgtttttcagctccagattttctattttgttccttttttttgtgagacagggtctcactctgttacccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcat

SEQ ID NO: 100085 - DNA, 2811 bp, Homo sapiens
cttgttggcctactggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcga

SEQ ID NO: 100086 - DNA, 5300 bp, Homo sapiens
  misc_feature (4925)..(4925): n is a, c, g, or t
cttgttggcctactggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgtttttttttaattccagggggttggttggttggttgaagagccaaaattttaaccatttttaagcatataatttgggggtatcagttactggatctaagcatgtccactctacacgcntttttttttttttttttttttatttttgtggagagagagtggggctctgtgtgcctctgtgtttcccccggggtgtgccctgtgaggggggcgtgtttctctcgcggcctcaccggtgcaccctctctgtgcctcccccgagtttcaggccaattctccttctgtgcccctcggccctctcccgagtgttgggctgtgggcacaccgccgggtgtgtggtgtgcccccacgcccccagccttatttgtggtgcttatttttagagtgctgagagagacacggggtttcccaccatgtgtgtggcgccgggggtggccttcaatacccccaaaaccttcagttgtctcccgggccactttgggcctcccccaatgg

SEQ ID NO: 100087 - DNA, 3477 bp, Homo sapiens
  misc_feature (3102)..(3102): n is a, c, g, or t
agccagagagtaagtgctgaatgtgacgcagaatcatgttaggtaacaaggactttgaggtaagtggctgaagtcttctgtggagtcagccgactcttgcaggattgtgtggtatcagtcacctttagcatttgccaacccaactctgatcattcttcttctttcaaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgtttttttttaattccagggggttggttggttggttgaagagccaaaattttaaccatttttaagcatataatttgggggtatcagttactggatctaagcatgtccactctacacgcntttttttttttttttttttttatttttgtggagagagagtggggctctgtgtgcctctgtgtttcccccggggtgtgccctgtgaggggggcgtgtttctctcgcggcctcaccggtgcaccctctctgtgcctcccccgagtttcaggccaattctccttctgtgcccctcggccctctcccgagtgttgggctgtgggcacaccgccgggtgtgtggtgtgcccccacgcccccagccttatttgtggtgcttatttttagagtgctgagagagacacggggtttcccaccatgtgtgtggcgccgggggtggccttcaatacccccaaaaccttcagttgtctcccgggccactttgggcctcccccaatgg

SEQ ID NO: 100088 - DNA, 5685 bp, Homo sapiens
  misc_feature (5310)..(5310): n is a, c, g, or t
cttgttggcctactggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatggtaggagcctgcacccggccaggcaggcgtgacccaggaggcggtaccttccatggcggagactggcatgagctcgagactgccagttacacatctagcaaagtacacaccgttttgaacccctgtggaaatcctagttcccatttcaggactatttgactagtgcctgaactagaaactaattcaaaaggtttattttgttttaatacgacttagagtagaatggaactgttcttccacaccctcacccaaattgtactgtccaccaatattttgaagaattcatttacccaaaacattcatttttgtttgtgactttttttttaggagaaaaagaaaacaggtttaatttttctacattaaagtccctttttcctttttaaagcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgtttttttttaattccagggggttggttggttggttgaagagccaaaattttaaccatttttaagcatataatttgggggtatcagttactggatctaagcatgtccactctacacgcntttttttttttttttttttttatttttgtggagagagagtggggctctgtgtgcctctgtgtttcccccggggtgtgccctgtgaggggggcgtgtttctctcgcggcctcaccggtgcaccctctctgtgcctcccccgagtttcaggccaattctccttctgtgcccctcggccctctcccgagtgttgggctgtgggcacaccgccgggtgtgtggtgtgcccccacgcccccagccttatttgtggtgcttatttttagagtgctgagagagacacggggtttcccaccatgtgtgtggcgccgggggtggccttcaatacccccaaaaccttcagttgtctcccgggccactttgggcctcccccaatgg

SEQ ID NO: 100089 - DNA, 3862 bp, Homo sapiens
  misc_feature (3487)..(3487): n is a, c, g, or t
agccagagagtaagtgctgaatgtgacgcagaatcatgttaggtaacaaggactttgaggtaagtggctgaagtcttctgtggagtcagccgactcttgcaggattgtgtggtatcagtcacctttagcatttgccaacccaactctgatcattcttcttctttcaaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatggtaggagcctgcacccggccaggcaggcgtgacccaggaggcggtaccttccatggcggagactggcatgagctcgagactgccagttacacatctagcaaagtacacaccgttttgaacccctgtggaaatcctagttcccatttcaggactatttgactagtgcctgaactagaaactaattcaaaaggtttattttgttttaatacgacttagagtagaatggaactgttcttccacaccctcacccaaattgtactgtccaccaatattttgaagaattcatttacccaaaacattcatttttgtttgtgactttttttttaggagaaaaagaaaacaggtttaatttttctacattaaagtccctttttcctttttaaagcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgtttttttttaattccagggggttggttggttggttgaagagccaaaattttaaccatttttaagcatataatttgggggtatcagttactggatctaagcatgtccactctacacgcntttttttttttttttttttttatttttgtggagagagagtggggctctgtgtgcctctgtgtttcccccggggtgtgccctgtgaggggggcgtgtttctctcgcggcctcaccggtgcaccctctctgtgcctcccccgagtttcaggccaattctccttctgtgcccctcggccctctcccgagtgttgggctgtgggcacaccgccgggtgtgtggtgtgcccccacgcccccagccttatttgtggtgcttatttttagagtgctgagagagacacggggtttcccaccatgtgtgtggcgccgggggtggccttcaatacccccaaaaccttcagttgtctcccgggccactttgggcctcccccaatgg

SEQ ID NO: 100090 - DNA, 2947 bp, Homo sapiens
  misc_feature (2572)..(2572): n is a, c, g, or t
gatcattaaccctaaaaacttttttctctccttacaggtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgtttttttttaattccagggggttggttggttggttgaagagccaaaattttaaccatttttaagcatataatttgggggtatcagttactggatctaagcatgtccactctacacgcntttttttttttttttttttttatttttgtggagagagagtggggctctgtgtgcctctgtgtttcccccggggtgtgccctgtgaggggggcgtgtttctctcgcggcctcaccggtgcaccctctctgtgcctcccccgagtttcaggccaattctccttctgtgcccctcggccctctcccgagtgttgggctgtgggcacaccgccgggtgtgtggtgtgcccccacgcccccagccttatttgtggtgcttatttttagagtgctgagagagacacggggtttcccaccatgtgtgtggcgccgggggtggccttcaatacccccaaaaccttcagttgtctcccgggccactttgggcctcccccaatgg

SEQ ID NO: 100091 - DNA, 2076 bp, Homo sapiens
  misc_feature (1701)..(1701): n is a, c, g, or t
ccggatattttgttttcattttcagtcatctctaagtattttgtaattttccttgtgatttattctttgatccattggtttaacagtgtgttaattttcatgtatttgtgagttttctagttttccttctgatattgatttctagtttcattcaattgtggtcagagagaacgtactttatatgactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgtttttttttaattccagggggttggttggttggttgaagagccaaaattttaaccatttttaagcatataatttgggggtatcagttactggatctaagcatgtccactctacacgcntttttttttttttttttttttatttttgtggagagagagtggggctctgtgtgcctctgtgtttcccccggggtgtgccctgtgaggggggcgtgtttctctcgcggcctcaccggtgcaccctctctgtgcctcccccgagtttcaggccaattctccttctgtgcccctcggccctctcccgagtgttgggctgtgggcacaccgccgggtgtgtggtgtgcccccacgcccccagccttatttgtggtgcttatttttagagtgctgagagagacacggggtttcccaccatgtgtgtggcgccgggggtggccttcaatacccccaaaaccttcagttgtctcccgggccactttgggcctcccccaatgg

SEQ ID NO: 100092 - DNA, 2571 bp, Homo sapiens
cttgttggcctactggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtaagtatgaaaaaacaatttatatggttattttttatttaatttttgaaaattaatattatttttaaatacgggtttgccttctttctatgaaaaccttggttttaagtatatattatatttttatgcctgtaactaattcatattttaaaattttgatcaaataaaagaaaaactgaca

SEQ ID NO: 100093 - DNA, 1421 bp, Homo sapiens
  misc_feature (1046)..(1046): n is a, c, g, or t
tacaaccactaaaattcgcggccgcgtcgacgtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgtttttttttaattccagggggttggttggttggttgaagagccaaaattttaaccatttttaagcatataatttgggggtatcagttactggatctaagcatgtccactctacacgcntttttttttttttttttttttatttttgtggagagagagtggggctctgtgtgcctctgtgtttcccccggggtgtgccctgtgaggggggcgtgtttctctcgcggcctcaccggtgcaccctctctgtgcctcccccgagtttcaggccaattctccttctgtgcccctcggccctctcccgagtgttgggctgtgggcacaccgccgggtgtgtggtgtgcccccacgcccccagccttatttgtggtgcttatttttagagtgctgagagagacacggggtttcccaccatgtgtgtggcgccgggggtggccttcaatacccccaaaaccttcagttgtctcccgggccactttgggcctcccccaatgg

SEQ ID NO: 100094 - DNA, 485 bp, Homo sapiens
tacagttcttccaatatcatgggcaacttgtagccagaattaagtagaagataagattagaattgaatataataacttttgatttatcatagtgccttttaaatacatagtacctctttgctatattatagtgatagctaaatgatcttttcacattcctaagttttgatttctgaatggcgtcgctcctgcctcctgacatctcacactgtgaatgtgctacttgctttctctaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgagtaagatttggaaaattccctgtctgtcttcatactggaagagtatggaggagggttgataatcatattcaagtgatatacacagtggtgtagctttagttatgggaa

SEQ ID NO: 100095 - DNA, 819 bp, Homo sapiens
aaggctaggtacgaggctgggtttgaatcggccgaggccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaggtctggccgtgattttccccttgggttgccgtgcctgttttactatccccgggtaacccgtggccggtgtgaaaaagggtcacgtgacactttcttgc

SEQ ID NO: 100096 - DNA, 5240 bp, Homo sapiens
  misc_feature (4865)..(4865): n is a, c, g, or t
cttgttggcctactggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgagctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgtttttttttaattccagggggttggttggttggttgaagagccaaaattttaaccatttttaagcatataatttgggggtatcagttactggatctaagcatgtccactctacacgcntttttttttttttttttttttatttttgtggagagagagtggggctctgtgtgcctctgtgtttcccccggggtgtgccctgtgaggggggcgtgtttctctcgcggcctcaccggtgcaccctctctgtgcctcccccgagtttcaggccaattctccttctgtgcccctcggccctctcccgagtgttgggctgtgggcacaccgccgggtgtgtggtgtgcccccacgcccccagccttatttgtggtgcttatttttagagtgctgagagagacacggggtttcccaccatgtgtgtggcgccgggggtggccttcaatacccccaaaaccttcagttgtctcccgggccactttgggcctcccccaatgg

SEQ ID NO: 100097 - DNA, 4381 bp, Homo sapiens
cttgttggcctactggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtattcttatggtttttcgttacagtaccgaatgaagagtgcccaaggattaagtatgctagacctaaattggttcagctgctggacgaattaagatgtcaaagtgccaaatggtacataggtaaatagttaaggctacttgtacccagagtaattatttctagtgccacggtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccaggcatacctgccaagaggcccttgccgggctgtgtgtggggtgtgtggcggtggt

SEQ ID NO: 100098 - DNA, 2755 bp, Homo sapiens
cttgttggcctactggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaggtctggccgtgattttccccttgggttgccgtgcctgttttactatccccgggtaacccgtggccggtgtgaaaaagggtcacgtgacactttcttgc

SEQ ID NO: 100099 - DNA, 446 bp, Homo sapiens
ccagagcagcggcctgggagccaccatgcgacccagccctaaatgccttgcttatgatgaaatctcttgaaaatagcccaacttctgtctcctgcctgtgaagtaagcattctcctctaattctcaaagctgggattttgtgagaaacttaagttgtcaggagcacactgggggaaacataattggaaatacatgttatgacccattagaatgacaagttgtatatatccattgtaccctaaggcatccaatatattctgctgtgtttgtaagtactttaatcatgttgaagaatgacatactgaaacttgtccctgagattcacacttgatctcaagttgattgagtttagggaaaagggaaaaaaaaaacacattagcgtgttatttttgacattatatgagggttttcatgggtgtgaactgtgagggaggtgtgcaagacat

SEQ ID NO: 100100 - DNA, 223 bp, Homo sapiens
gaagggtgatgcggttggagagcaggggtgccaaatgttccctctcccccaaccagcagcctcaggagaagacataactgctgggggccccttggacctaaaccaggctgtcctacgcactccctcaatgggactggtcaccctcttcttgcctgcattcctctataacgaagggaatgtgtaagctaagaaaactcgcccggcccatggcaccgatttacta

SEQ ID NO: 100101 - DNA, 572 bp, Homo sapiens
tcatgagggctccaaccccatgacccaaatagttcccactaggtcccaactcctgacaccaccacattgaggattaaatttcaagtgagtttcagaggatataaactcaaaccatagcagcaaggaactgaatgtagccaataacctgaatgagcttggaagcagcttcttctccagagcctccagaaagaagttcagtccacctgagaccttgattctagcctcgtaaggccctaatacggttttcttctatgtacccacccaaatctcatgtcgaattgtaatccccatgtattgaaggaggggcctggtgggagatgactgaatcatgggaatgaattacccccttgctgttctcgtgatagagttctcatgagatttggttgtttgaacgtgtgtagcacttcctcctttactctctctctctcctgctctggccatgtgaagactgtgcctgcttccccttcaccttctgccttgatggtacatttcttggggcctccctagccttgcctcctgtacaccctgtggaactgtgagtcaattaaacctcttttcttttaaattaccca

SEQ ID NO: 100102 - DNA, 246 bp, Homo sapiens
ttttttttttttgatacttcacattcttaccccaaaattcatttagggtatatgttctcaccctaaaattgggcaaaaccaaaatatttcatgcaatctaaaaataatctgtatttaaccatgttcatcatcattcctaggtgggcaattaaaccactattaaaccatagtggtatggatgtaccgacataaactactaagtagtaaatagaacttgctaacaaataccgctatgcagcaattcac

SEQ ID NO: 100103 - DNA, 774 bp, Homo sapiens
ggtggctcctgctactgctcaccccacaagccctgactgctaatatctgcccaggccctgtttccttccctagtattcctgtgggctggttagcttgttactcaagagccaccgtgtggagtccatgctcctatagtagcctaaaatgaggaaactgcccttcattaacccaactctagcttgttccaaaacatggagcacagaacattgctgcctgtaacccctggaatggcacaagattatctatttatttatcctttaatcacagctggaggcctcagatatgaatattcaggattggtgaaagaactcaacaatttgactgagtgtcataattgtggcacagggaggaaggaaggacagcatacgaagcccttaatcacacgctacccagataccagcataaggcccgacattctagaacaggggccagctcatggcctacttttctttggccggtaagctaagaatggtttttacatctttaaattgttgtgaaaacaaaacaaaaaacaaagaaaatgccagagacctatgtgacatgcaagcctagaatacttactgtcaggcctctgagcccaagctaagccatcatatcccctgtgacctgcaggtaaacatccagatggccggtttctgccttaactgatgacattccgccacaaaagaagtgaaaatggcctattcctgccttaactgatgacattatcttgtgaaattccttctcctggctcatcctggctcaaaagctcccctactgagcaccttgtgacc

SEQ ID NO: 100104 - DNA, 323 bp, Homo sapiens
tatcagctggtaccttccaccagcaagaccctccagcatgtggataaggttcgggctccaaagtcagaatcacaggagtttgaatcctcagctctgccccttaccagctggctgaccttgaggaggcatcttaacctctgagctgcctcatgtagaaagtggccatatgaggttcttacagctcaaggcctgcagctgcatggaaagtaggcagggaaccaaggcatacgggtggaatttggagtcacctttggttttgaatcctggccctgcctcttagctctctttgggcaagtcacttcactctctactttagctttctc

SEQ ID NO: 100105 - DNA, 344 bp, Homo sapiens
aaaataaaataagaaataaaaagccacccacaggggaaggtgaaaacacagggctggaagctaggcctccttaaacatacctcattttatagacttgactttgcaattaaattattttcaaatttccacaacaaaatttgaaaatgaggccaggcgcggtcatgcctgtaatcccagcactttaggaggctgaggcaggaggatcacttgaggtcagaagttcgagaccagcctgggcaacatggtgaaacctcatctctactaaaaatacaaaaattagccgggtgtggtggcacacagctgtgatcacagctacttgggccttttatcacctacttgggagg

SEQ ID NO: 100106 - DNA, 356 bp, Homo sapiens
ctgagaggccgtgggcctgcgagtcctgtctctgcccctcagcctcctcctacatgagatggagacaatgatccccgtctctgaccctgcacagtctggggctgtgtgaccaggagcaaggcctggagcggagaagttgagggagtggaccctggggtcagttggacctgggtcctactcctgcttctgccatttcctggctgggtgaccttgggcaagtcagtgagctctcagagtctaatatgcggccctcgctgatgctctgcaggggaaggggaaggggaatgatctggagaggcagtgggttctctctatcttgctggctgttgttatgtcacgcccatcccatccccatt

SEQ ID NO: 100107 - DNA, 519 bp, Homo sapiens
gtggtggtggtggcggcagcagtggttgtagtagttgtggcgacggtggtggtggtggccatggtggtaggtgcgacagttgggatgatggggactgttgtggcttcggtggtggcagcaatggcagtagcatcggtactgctcacagcgcccgtcgcacccacggtagtcgggggcaatgtgggaggagctgagagggaaatgtaaaacagccgagtctggttggtttggctgtgcccagcctggacacacggcccccgcgtgcaaggcaggcagcccggtgaggagacggggcttagtcatcaggagcctccccaagcataacggactgggtcagacgggtcgcagcaacagaagacacaaccatgggagaggaagagaatgaagccctgtgtgtgtttcattttcttctcatggtctgcgtggctcgaaacacccagcatgcacccagccaaggatgcgtgaggatgagacgggaagggggcacgggctgaatcgctcagaccccagggatggcat

SEQ ID NO: 100108 - DNA, 540 bp, Homo sapiens
tccacagaaaagccacagggatctttctgaaagcctaagtcgaatcgcgccagccccagctcaaaccttccactggctttccaccacaactagcatggaatgtgacctccttccaccgccctcaggggcctgcaggatgcagctctgattcccctccctcctcgctcgcctccaagctccaccttcacttcactgcagccacagcggccttcttggagaaggaccacatgcacaccaagctcatccccacacacccctccttagagggttatgtgcccccaaatcatcaggtggctatctcctctcatcctttgggtctacgcttcactgtcaccccatcagaatgaccatccaaatcaccttcataagcagccccttcttcacccctgcaccgtccaacacaggagcctcgagccacggaagctacaggacacccaaaaagtggtccagctgagagacgctctaagtaggaaacacactctaggcttagtacagaaaactgagtgtaagttatctcattgacagtttttatatctatta

SEQ ID NO: 100109 - DNA, 297 bp, Homo sapiens
  misc_feature (14)..(14): n is a, c, g, or t
tgaccagaggatcngggatgaggaacgtactagatttaaaaaatgatcacatcattaattacgtgtaaagagatcagattaccaaaatgtaggtgaatgatgagaaaagtcagtaggagcaaaagcaataaatactcttctcccatttgctaccacttacttttgaagttgcttcttgttggtaggtaccaagaaaataaagaggtcatattaaagagacatcaccaggaattatgagtagcaatttcaaacataaaatctgacttaaaaaaagtgtattcatgaaaacacaccaag

SEQ ID NO: 100110 - DNA, 494 bp, Homo sapiens
gactctagatgaagtggccataatagagcagcacattaacagaaataggaaatagtacataaacaatttgtgaagaattttagcacatgctatcccatttaggcctagcaaaaactctgtgatgggggaaactgaagcttagagagtttgaatgaaatttccagctaaaatggtcttattttagctgatttttttaaaggtagtaacattttattttatttagttgacattttgacattccccctctaactttaatacccttaccaaatgtaaaggtaaatacaatctttaaaaagaaattagaaagaaatacaatgcctataatcaggacacacatctcatgtactagaaatgaaacggcaacacaaagccataaggagcactgaagaaagaaatagcgcgtctagaagcagactggggtattgattgcaatggagctccactgctcttgaaaaggcctgaaaaaaattctgccccattcccaagagcctcgt

SEQ ID NO: 100111 - DNA, 442 bp, Homo sapiens
ccctcctggttggttcttactgtttgagtcaaaacctcatcaatatatcattgactcctgggttccctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaacaggatctatgcatttattaaatctggaaaactatatgta

SEQ ID NO: 100112 - DNA, 335 bp, Homo sapiens
aagccccttgtgaatcagcctcctgctgacactcccctacccatacctaccccatatagcaatcacacacaggaaatctcttgcaagtcaaaggccccatgctctcctgggcctccgtgcctttgcacgtgctgctccctctgcctggtgccttcctgcctggctcactggatcatccttcagaatgcagttcagggagcatttctatatgacatccctgaccatcatgctctggctgaagtgcttgtctatcccttgccatagtccctgccatggctgtatctgatgagtgcgttgatctgtttagcttcacactaggtttagtggagatctgt

SEQ ID NO: 100113 - DNA, 167 bp, Homo sapiens
agaacccatcattgagatatcaaatagctgcatcaaaacttgcctgaagtgtgtttgttcccctgttcttttgccaaatggagctaggcaggcggcataccccaccctcccgggctcagcaattggtcctcaagagctgggtgcttcacttaagttcttctttcagt

SEQ ID NO: 100114 - DNA, 469 bp, Homo sapiens
agaaagagggaatgcagagtgatggaagggtagctgtgaaccttcagctttataatgaaggtagcttgatcatatacgaggtagttatggagattttaagcaaatcttgtttttgatggttacaaaaagtgttctgaattctatcaaatttggaaaacaccactttttctccctccccaatctcttccataattatattgcatataattatcttagtcttccataaattatcatgcatattatgaatctttaagagggaaataggctgggcgctgtggctcacgcctgtaatcccagtactttgggaggctgaggtgggtggatcacctgaggtcagaagtttgagaccagcctggccaacatggtgaaacccagtctctactataaatacaaaaattagatgggtgtggtggtgcatgcctgtaatcctagctacttgggggctgaggcaggagaatcacttgaactc

SEQ ID NO: 100115 - DNA, 403 bp, Homo sapiens
ataaaaaggggattaataatgggtaccggggccatcctaggttacctgtaattaaataaaattacattccacaaagcacttttggcacatagcccaaccccacagtaaacacctattagtaaccttagttcattaactgtttactgtatactctaataaatgtctgatacacacccacacccacctgcacatacacaaatgctcatagtaattatgtaaggcaagtattatctccacatttcagacaggttaacttacacagctattatagtaagtgatagagcagaacttaaaaacccagtatgattcaggtccaaactccttttctttctttatataaccataatatttcaaattaagtaagatttcctatataacgtcctgcctctcatcattatcatca

SEQ ID NO: 100116 - DNA, 380 bp, Homo sapiens
tatttgtatttatttattttgagacggattctcactctgtcactagagtgcagtggcacaatcttgactcactgaaacctccacctcctgggttcaagcgattctcctgcctcagcctcccaagtagctgggactacaggcgcatgccaccatgcccagctaatttttgtatttttagtagagacggggtttcaccaagttggctaggatggtctcaatctcttgacctcgtcatccacccacctcggcctcccaaagtgctgagattacaggggtaagccaccatgcccggccaatggtgtggtaatttctaaggaaaatcaataaaataatattttcatatacatctgaagtgtaatattaataacttttcacagaaa

SEQ ID NO: 100117 - DNA, 706 bp, Homo sapiens
tgcagtttcagtcctgaggccagcgggaccaggaactcaccggaaggaacgaacaactccagatgtgccacctttaagagctgtaacactcaccgttaaggcctgcagcttcactcctgaagtcagcgagaccatgagcccaccagaaagaagaaacccaggacacatctgaaaatatgaaggaacagactccagacacactatctttaagaactgtaacactcactgcgaaggtccgcggcatcattcttgaattcagcgagaccaagaacccaccaattctggacacaatcacaaaattaaacctcctcaaatagagattgacagtaaatgtaatctgtatttctgttcatgccatcattggtagtgaattatttaaatatataaaacattgtcgaataactcgtaacaggacaattacctatctaatttttgctcattataaaatgaaatgtaatctccgtctaataatttaaattgtttttacaagctggtctaacaggaatgtttcttattcttccatatgttcttaacagacttactttgtttttactctttgtcatctttataaaatcacaaatctctacattatgtatttatgcgaaacatacacttctcttggattgtcaaaacgaactttctcccataaaaaacattgtaatatttagctttaatagcctctccccagagtgaaagaaaaccttat

SEQ ID NO: 100118 - DNA, 687 bp, Homo sapiens
cggcatcccaccgccctacgacaagaaaaagcggatggtggttcctgctgccctcaaggtcgtgcgtctgaagcctacaagaaagtttgcctatctggggcgcctggctcatgaggttggctggaagtaccaggcagtacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaagaaaatgacaagaaaaagagacacacagacaccaacacgaagatcaggagcgagagcgaggcgcgggcgcggcggggcttccagaaagaaagaggagggacgaaaagaagagacaagaaaaactgaaaaatgaagcatagaacgacagatgaaaacaacaaactgaaaagcagtaaagatgaatatatgcagagcggagcaagaacaaagaaaaaaaaacaaaagacaagcaagtagagaaagaagaaaccaca

SEQ ID NO: 100119 - DNA, 539 bp, Homo sapiens
gcggccgcctactactactactgctcgaattcaagcttctaacgatgtacggggacatgaggctacggaaacaggccgagaagaacgtggagaagaaaattgacaaatacacagaggtcctcaagacccacggactcctggtctgagcccaataaagactgttaattcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaagaaaatgacaagaaaaagagacacacagacaccaacacgaagatcaggagcgagagcgaggcgcgggcgcggcggggcttccagaaagaaagaggagggacgaaaagaagagacaagaaaaactgaaaaatgaagcatagaacgacagatgaaaacaacaaactgaaaagcagtaaagatgaatatatgcagagcggagcaagaacaaagaaaaaaaaacaaaagacaagcaagtagagaaagaagaaaccaca

SEQ ID NO: 100120 - DNA, 806 bp, Homo sapiens
  misc_feature (524)..(524): n is a, c, g, or t
  misc_feature (556)..(556): n is a, c, g, or t
  misc_feature (564)..(564): n is a, c, g, or t
cggcatcccaccgccctacgacaagaaaaagcggatggtggttcctgctgccctcaaggtcgtgcgtctgaagcctacaagaaagtttgcctatctggggcgcctggctcatgaggttggctggaagtaccaggcagtacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaaaaaaaaaaaaaaatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccantaggaagagcaaccagttactatgagtgaaanggagccanaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaaaa

SEQ ID NO: 100121 - DNA, 889 bp, Homo sapiens
cggcatcccaccgccctacgacaagaaaaagcggatggtggttcctgctgccctcaaggtcgtgcgtctgaagcctacaagaaagtttgcctatctggggcgcctggctcatgaggttggctggaagtaccaggcagtacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaaaaaaaaaaaaaaaaaaaaaaaaaaaaaaaaaaaaaaaaaaaaaaaaaaaaaaaatgtgtggtggcgcgcgcgcgcccggcgcccccgaagaaaacctttctcaaacacacaccccgcggggggcgcgcgcgcggggcccccctggaggcaacggaacaccaggggcgccaaggcgggtgttcccatagggagaaacccgcgggcgaaagaaagcaaagggcgcgggggagctcccccacaccaaatataaaaaaaaccgcgccgcggggagagaaacaccaggagagggttgtcttggagaaaaatcccacaagaagagggagactctagagagggggcgctcaatacagggggcagcattatacaagagagaggaggcgcgcgcacaggcgagagagcgcgcgagatatctatcacatattataaacgcgccccggaaggagcggtgggggggaggaccaaacacacacagactgaagcacacccaacgcaacccaacaaaaccgaacgagaccacgaagcataccaaacgcaatcgacaatcaccacgacagacgaccgatagc

SEQ ID NO: 100122 - DNA, 387 bp, Homo sapiens
taaaatacccttgttgctgcttttcctccaggtttcgcagtctagggaatctatagcaaagcgagctttctatcaaagcaggtattgccaggaagagatccagaggactggggcttctgttccccaagccacttagaaatgtgctccaaattggttccgttcctggagccgggtctgctttggggttgattgagcagtgaaagaatttgaggatgtgagaatctcccaaactaatcacagtctcctgctggggactgaaacccacatgcattaccatggcagtgtctgaagacatcatgaacccttgaaaactatttcctggatgaatattacactaagtcattatcagtcatttgtgcctgggtgtagatgtgactatttaattct

SEQ ID NO: 100123 - DNA, 821 bp, Homo sapiens
tctttaaccactttccccccccccagtttttcacttgacaccttgtcatgagttacagtggcttgcatcaatcattctgggttcacacagaaaatattttgtggtggttgactatcacatgcgagaaactaagtgccctttgcgggtgactgcgcaggtacctctgatttcttgccaaatcattcagaatgccgcaaatccattaaatctctccacagggaggaaaaagttcccgcattctagagagagaatttatgagttcatttcaatcaccacaaatgaaagccacccttaatattcattagagattttacagtggcaatatgcattatctattcatatgcccctctaaaaggccaatttcccttgaaaccttgcatggctccaagccactctttgtagaaacaatggcctatgtccaagtggaatcaggggaggcaaatggatgacatttccttatccattggtagtaattccactaagccactatggtggctatgagtttctgagctttaaaaattaaaggacagatttggaatgtgcagtcgtgtcattgtatcacttctctgctgtcatctgtgaccatatgtcctaaattgaatagagcttttcggttggcatcacaagagatgacttttgaaactgacatttctttcatttggagaaatgtatatgttggagacataatcctatgagcctgagagcttttcattaatctctgtctttctaccaccatagttcacgccaccatcatctttcatctatttttcccttcaaatctattttcttcactgtatgtagagtgatctttccaaaatatc

SEQ ID NO: 100124 - DNA, 326 bp, Homo sapiens
tggtacctacaaaattactttagggtcatgttatatgtggtcttttactggatggcattggaatgaattaccatttgaggtaacagaattatctttcctagagttctttaaaaataggataaatactggcagagttgtgatgctttgatttaagccaatagaggtcagattttttgatatacataggtcttttgatttagtaagatgaatttattcagaattcaaagatcttttcaaaatacactctcctatatggaggcggtaggatctgaaccaggggaattacaaatggttttaacaggctgaaagaggggttttgaagtaca

SEQ ID NO: 100125 - DNA, 415 bp, Homo sapiens
ataccatatccctgacttcagaaacagatagtgaagtatgcattattttctaactccttttcaggcaatctgtgtttcatgaagcagagtgtaagtgcttttcacagaaaaattccatctgtcttatactaagtattgtttatcccagatccagcattgaaatatctattagtcttagtttttggtcttgatgtgagttttcaccttttttagtggcttcaagggtgtttaatgcaatgttgggaaaaggtacatagaaagaatgtgtaaaggttagcaaaaccctttctctttctgtgtggacaaaatttaccttggattaactttctaattatatttccctagaaacctgtaaatggcagaatgtgaactgtgtaactagcaatgttgtttatagtaaaaataatcctgattg

SEQ ID NO: 100126 - DNA, 651 bp, Homo sapiens
acgtggtacacgcatcgcggagggagcggaggtggttgggtttctgagtttgagtctgtcgctcctggctctcccgacacaacagcggcgcccacctgcccgcaacggactcccaggagcctcgagctcctcatttccaaagctgaactgccccgtgtctgattccgatttctcttgagcgcgtttcggagccggcccagaacagagggaagccagacacaccatacccggcccaacagtggcagggcggctgcgggtgctggtcaagctgggtcacccggcactgagtgacgatcagcaaatactcagtggacgaaatatttgcagtgcagtgaggtgaggggcataaccgcggagcgtattcgaagagatgagagagactggggattaggccaggcttgaagggaagaatggtttgagcaccgaggacaagaattaattccccaggcctgggttccagccttgtgcggctatcacgtgcttgaaacctggctagtccggagtgagatgcgctttacgtgtaaaatacaggattccaaagacgtcgtataaaataatttgtatattgtttgcatgttaggtaacatttttaatgtattggattaaataaaatgcattaaaattatttttacattccttttaaaaaaaaaa

SEQ ID NO: 100127 - DNA, 625 bp, Homo sapiens
acgtggtacacgcatcgcggagggagcggaggtggttgggtttctgagtttgagtctgtcgctcctggctctcccgacacaacagcggcgcccacctgcccgcaacggactcccaggagcctcgagctcctcatttccaaagctgaactgccccgtgtctgattccgatttctcttgagcgcgtttcggagccggcccagaacagagggaagccagacacaccatacccggcccaacagtggcagggcggctgcgggtgctggtcaagctgggtcacccggcactgagtgacgatcagcaaatactcagtggacgaaatatttgcagtgcagtgaggtgaggggcataaccgcggagcgtattcgaagagatgagagagactggggattaggccaggcttgaagggaagaatggtttgagcaccgaggacaagaattaattccccaggcctgggttccagccttgtgcggctatcacgtgcttgaaacctggctagtccggagtgagatgcgctttacgtgtaaaatacaggattccaaagacgtcgtataaaataatttgtatattgtttgcatgttaggtaacatttttaatgtattggattaaataaaatgcattaaaatta

SEQ ID NO: 100128 - DNA, 711 bp, Homo sapiens
acgtggtacacgcatcgcggagggagcggaggtggttgggtttctgagtttgagtctgtcgctcctggctctcccgacacaacagcggcgcccacctgcccgcaacggactcccaggagcctcgagctcctcatttccaaagctgaactgccccgtgtctgattccgatttctcttgagcgcgtttcggagccggcccagaacagagggaagccagacacaccatacccggcccaacagtggcagggcggctgcgggtgctggtcaagctgggtcacccggcactgagtgacgatcagcaaatactcagtggacgaaatatttgcagtgcagtgaggtgaggggcataaccgcggagcgtattcgaagagatgagagagactggggattaggccaggcttgaagggaagaatggtttgagcaccgaggacaagaattaattccccaggcctgggttccagccttgtgcggctatcacgtgcttgaaacctggctagtccggagtgagatgcgctttacgtgtaaaatacaggattccaaagacgtcgtataaaataatttgtatattgtttgcatgttaggtaacatttttaatgtattggattaaataaaatgcattaaaattaaatattacagttaatgaccgcgtttacacgtgtgactgagacaccctgcgtacccactaatcgcttgagactatcccttggcagcg

SEQ ID NO: 100129 - DNA, 621 bp, Homo sapiens
acacgggaaagaccgtcgacgattcaattacctcccaccaggtccctcccacaacacataggaattatgggagctgcaattcaagatgacaattgggtggggacacagcaaaaccacatcacatgctgagctgtagcaggtgaataaaccactgagactacgaacctctgtcctctgaagaagatgccattttctcaaattctaggagtgtgggccactgttctgaggttgctgcagaggagcactgctggagaaaaggaagggggaaatccacatatccactaagacatcgtcagaatactgcacatggaattataggatattaacaatttaagagactgtagacacaggatagtcaaaatctcccattttacagacaaatcaacagaggcccagagcagtgaaggcatttacccagacactcactggatcggtgcagctggatctagatccaggtctcttgactcatttaacagctgttaaaccaaaaatgggtgtgatttagtcccattgtcatctgatacattggcaatgccctgcatatttttttgtctctatgtttaatactcctttgtaaagggtagcttttgatatttcctgaactgagcatctgttaaaatt

SEQ ID NO: 100130 - DNA, 539 bp, Homo sapiens
ccctttcctctgacccaagttaacaaaggcatagatgagaaagctaagaaatgacaggtcaaagccaaaaacacaaaacaaacaaacaaacaaacaaacaaacaaacaaaactactcaatgcccatctgagacattttcacttcatgctcagtgaagtgccattttttgccatttttcaccctttccctatgatttgaacagtctacgggtgaagattacataagagacaacactgccacttacatcttttgaatcgcaaatagaagatgcattaggaaatcacttaacctttcctaattattccttacattcactcactaggcatgctatgtgaaatgcggtagaggatgcagcaggtggccagatacagtttcaagtactgctgcagggactcggccaaatcgctgcaccgctttcagtctctgtgttatgcaaagctccctgggcagcacaaagcttctagggtcttctaggaggggaaatgacaacatagcagatagggtcttggctccccttcgatgcagcggcctcatcagta

SEQ ID NO: 100131 - DNA, 303 bp, Homo sapiens
gtgggaatgcagtttcttacatttagcataggatccagtcctcaactcttaagtatttgccgcacagaaatgaaaacttttgttcacacaaaaagctgcacttgaatgtttccactagctctattcaagattgccaacaactggaaccaacgcaactttattcctttatgactagataaaccgtggtatatccatttaaccaaactctgctcagtaataaaaacactgctgactcacccaacgacttgacggttctcacacatgctgaaagacgccagcctcaagaggttgcttacagtatga

SEQ ID NO: 100132 - DNA, 415 bp, Homo sapiens
gggctaaaaagagagagagagaaaaaaaagggcactactactaccatttcagaagtctgtcgtacataaaaggaacaattttgttatttctggctgcctgggagcaatgtattatactggcaagtgctttggagttacaccactggagtgtgaatctcggctctatcaataactagctgtataataatgagtaagttacctaacctttctttatccatttccttatttataaaaaagggattaataatggtaccggccattctaagttactgtaattaaataaaattacattcacaaaggcacttttgcacatagccaacccacagtaaacactattagtaaccttagttcatttaactgtttactgtatactctaataaatgtctgatacacacccatgcccacctgcacatac

SEQ ID NO: 100133 - DNA, 486 bp, Homo sapiens
tctctacaaaaaaataaaaaattagccgggcatggtggcacatgcttgtagtcctagcaacttgggaaactgaggtgggagatcgtttgagcttaggaggttgaggctgcactgagctgtaattgtgcctaagttcaaatggtgtcaaaggatcatgcagcagcttgctctgatagttctccagcctgggcaacagagtaagaccctgtctattaaaaaaagaaaaaggtagtataaccatcattatcatgtatttctaaattctcttgataaatacaattaatctgattttcaggaaattttttatttaaaataggctcatcgttgcattccttactgtaatttatacagatttgttgattgacaaatcactctctttgaaagtttcagtcattcaaacagtgctttacagttttaaagtttgggctctgccttaactattttgcacagagactcattacctttttataagatagcagtacacgc

SEQ ID NO: 100134 - DNA, 217 bp, Homo sapiens
agaaagagacagctccccaccaaaacagctcaatctatcaaaggccctactatggtctgaatgtgtcccccaaaattcatttgttgaaaacttcatccacaacataacagtgctgggagatgaggattttggaagatgttcaggtcataagggctttgccctcacagattggttaatgccattataaaagggcttaacagaggaagtttggtctctt

SEQ ID NO: 100135 - DNA, 683 bp, Homo sapiens
cctctccgacaaaatgagttgtatattcctcattaggggatgaatgctaaatgctttatttgtgggcagggcagggcattgaaattatttagcatttatctcctaaatgcttccccagggcttcaaaagagaagccaaatattatcctcatgtctgttgtcttcaattttagatttacagcagttcttctctgtaatgtgtgatataacaagaccagagtaaatattggcaaccttaggtgcatctataagttgggtataccctatttcatctgtttacttcaatatctgaaaattgactgcagttgacaatgtgggttcacttggctgagttcactctctgtaatatcactccaaggaggatgtcataaatcaggaagaagaaaaattagtttagaatgactgaactcatatgtggaatgatttatgttcaaatttctagttggtttagcaaacttgtatttatataaggaagtaaaatactgatgtaattacaatgctattctgatattaacaccaaactttcatccttaaggcaaatatttctgttttagtcctggtcttgatattttctttcataatcacaccctgacattgtctttaagcttctgtattgtgcatctgtttctatcgtaggcaatccacatttgattggttattattatattttaaagcagggctact

SEQ ID NO: 100136 - DNA, 238 bp, Homo sapiens
gtgaatcaaaaaagcccactctttggaaaggtggcctctgctctttcctctgctatgggccttacaccctctgctgaggccatcagtgttacaccctctggtgaggcctgagctgtgtgactttggaccagtaatttaacctctttgggcctcacttctttcgtctgtaaaatgggcctaatgcataccttacatttgtagtgggaagtaaatgaaataggaatcagggcttcatacc

SEQ ID NO: 100137 - DNA, 923 bp, Homo sapiens
tgtgcagggccctgaatgccaggacgggaatttaatctaattcaacttcagcaatgggctgagggacagcttcatgccaggcaaagggaaaaactctttacacacaggattgcctttgctttcattcaatccccgcaacaacatgtgtgcaaacctcccacctggcatcctgcgtgtgtccagcacctccctgcacccgggcaccactcatgcaggtgggcttggcatcctcacagcctctgcagcacgtgccttcagagggaagagaaccggggactcgggagactcaaggcatctccagagtcacagcctgaagacagaaccccatgctctcctggacataaaagccatgcggtccctggtagacaggatcccctccaagcattttccaaagcccgaggggctgcttacaagactctgcccatcacccccaacctggctgatctgggaccacatcagcacctggcctgactcttctaccaggatgccctccaagaccaacactgatgccttagtcaccctcaccagggaggctgggggtgcccccacatggctgctgcacctgatgttggaaacggaggctccaaaaacgtgagaaaaccgaggcccggaaagtgtcaacccaaatcacgacactccttgccccaaacccagaagcctgaggaagtaaggaagtgcggtgggatctgtcttcccgtgtgtcttcaggatcctggggcctgcccctcctggcttcctcttgaggaaggcctcagaagacccgcctttggtcacaggacagaagctgggccaagaggcaaaggttttggccgccacaggggaaactctgggctcagagctgccgaagtgactcacgggccctgctgggaagcagctgacgttccttgtctgcgccttacaaaaccacacgggctgcgagtgac

SEQ ID NO: 100138 - DNA, 450 bp, Homo sapiens
ggcttccttttattttcatacatcttcttattaaactatctcaaagagtagagattcctatttctgttgacacttaatagctttttcactacatgtaatattaagtccatataccttcagcttttttgaaccaccgtgcgcagcttgttttagcttttttaaagtgagttttagataaacctaatttgctcatccttgattaggaattccccaaattggctctaaaatggaattcagtttgcctcaatatacatttactgagcttataatatccattaaaaaaaaagcagccaggcctggtggctcatgcctgtaatcccagcactctgggaggccgagcaggaggaccccttgagccaaggagttcgagaccagcctgggcaaggtagtgagacctcatctgtaatcccatgtagttgccactgcactccagcctggggaacagaacta

SEQ ID NO: 100139 - DNA, 172 bp, Homo sapiens
tctttttctctttactcccgggttaaaaggagggaggttctgaagggaaaccccaggcagctctctttctgaatgcctgcagccccactggggtcctgctacttcctccctagggtctgcactgagaatgacggacttcaacctcggcagccttagccttccaagcgcatct

SEQ ID NO: 100140 - DNA, 431 bp, Homo sapiens
gtatatatacatatgtatatatgtatatattttgttgcctttaattacatttttttcagcccacatattagcttagagatgggaaattgattacatttaaaatttttaactctgaatttattaccaagcgttttaatctaatacatattttcttaatattttaaacaaagaataaaagtcctcattttttttaacttgcacatgaatgtacacatgaataggaaggcagatagatagatagttagacagatactttcaatatatggtagcttgaacatgacaaagactctgtccttgacctaatgttagacaggctcctctgatccctcttcttatgagggcttgtcctttggccttttcctggagcctgcccaacccagttgtagcaaaactcctgttaagtcactttaatatttaaggagaggtgagtc

SEQ ID NO: 100141 - DNA, 394 bp, Homo sapiens
gaagaattggccatctgtgattggctgagattctgttcctaagttaggttttcagtttgtttaagtgctgagttgggctgcatttaggaactcacacataggcctccttgggcccacttttaatttgttttaatagttgttcatgtgatttaaaggatttgattaaacacagtaaagaacttcctggtagtgaggacagctaaaagaatgagtgataaagagaaatttagcatctccctctctaggaagctgtataaacacactaactccttataagtctcagtaaatttctatgtaaaattcataatgtcatgggtatagtttgagctaaaatttacttctgctaactataacttctgtttttaagtttgcagagtaaataaattaagtgaac

SEQ ID NO: 100142 - DNA, 782 bp, Homo sapiens
aattagccgggcgtggtggtgggtacttgtaatctcagctacccgggaggctaatgcaggagaatcgcttgaacccaggaggcggaggttgcagtgagccaagattgcgccattgcactccagcctgggcaacaagagcaaaactctttcaaataaacaaacaaaacctaagcatttgaggggtttggcctgggcagtggagcttgtgagctatatgagctggaatctgagtcaaggctgggctggtgaaaggagttcactcaagttcccaaggtattctgtcctccaggactctgaatcacctgggaggagaaggaattgtggcgggcctaacaccttttctttcccaaacaccaagagcaggttctttctgttacatccattgaggtcacattcttgaagtgcattttgaggaagtcattattttcgctacagcagggactgatgtatcagtctattagaattcagaaaaaagtaagcaaacaaaaaacgtgttggaattattctcttctagcattttgaaatgtacaatggttaatgttaactatagccaccatgatgtattgaagaccaggtcttattctttttatctaactgtacatttgtacccattaacctaatgctcatagcatcaagaaaagatcaatatttaaggtgacaaatatcccaattatgctgatttgattatatgaatgtgttgaattatcatatgtactcccaaaatatgcacatctaagatgtatcaataaaaataaagacaaaaattaaagcttttacagtag

SEQ ID NO: 100143 - DNA, 681 bp, Homo sapiens
tagataccatttccttttcattttaaccaacaactcataattttatcttccaatagtctccaatgacctaaaacttcttcctagtagtaactcatttacattcttaaatagataattaatgtactttcagtaattaagtgctaggtacatgaagtcaaagtattgttcactatgaaatatccaatcactttgccaatatagtcaaatattaattgtccaggtgctaatccaccagttgatagattcttcatgggctctgcttcctcccttccacttagtgaccactcctcagctatgagcacatctgccaaagcaggtagacaggtacgtcaaaaatgctttacaactcaaatcaggcaattctattagtcaagttgctgttagcaacatttgccaggatttcctgtgtagatcattgaaactggttggcttgcaaagctattaaatgtctctgtggattataggtacatggacttggtgtcatcctccataaccatgctgcctgccagatgcaaaggacttaacatataacagacggtttcacatacattatcacatttgagctttacagtaatttgttatatactcattacatttccatattcaaaattgtttctctacaaccagagtgactcaatttctgctaacattaacatatcattttctttacctgccaaaaaa

SEQ ID NO: 100144 - DNA, 371 bp, Homo sapiens
gctggaggagaaaacactggctgtgcagaacttgactgggtggagggggaagggccgggggtggccagaggcggcttctgttgcacagaggtccggcttgctcgccagacaaagagccctcagaaagcaccttccccacctccgccacacacagagaaggcgcagagggcctggcctctttcttacaaggagcccggctgaccctgttgctgtgaggggcagaaagagaggcaggcagctgcttggagacgcgggagtcactgagcagggcccgcggagtctgacaacggaagaaaagaggcaacccttctattattagtggctgctttccacgtatgtgtaaatcagacagcctatgcaaaaagaggcct

SEQ ID NO: 100145 - DNA, 953 bp, Homo sapiens
gaacctgggaggtggaggctacagtgagctgagatcatgccactgcactccagcctgggcaagaaagtgagactccatctcaaaacaaagaaacaaacaaagtattaatatgttccccttgatcagtggggtggttcacccttgtaatcccagcactttgggaggcagaggctggcggatcgcttgagtccaggagttcgagaccagcctgggtgaactagcaaaaccctgcctgtactaaaaatacaaaaattaactgggcttggtggtgcgagcctgtaatcccagtggaggctgagacaggagaatccttttgtaatgcctgaccttgtttttttactaaccctattttaaccttgtttttactaaccctatttttaaattttccctttttgtctccttaattacctagccttgtttcccatatgagtagactctcccttagctgggaaagcctgacgaacgccatctggccccttgatttacaagacattaagggctacttacccaacccccttcctcaaagagttaacctgcgtaagcagatcctcagcatttcaaaggagcccaattagctgataaggtactggaacaaacaatgtacgaagttcccaggattttgctcaaaagcataacaacataaagccttgagtctgtgtctggcatagcatccatatctaactcttatgaaggatttagagcccggcacctggttccgttgctttttttgtaaccatttgtcttttaaattgtttatttctctgtaaccatttgttttttgattcttgcatgtttttacttctgtagaattattgcatttgagctccgctccccttccgaaccaaggtataaaagtaaatcaagccccttcctcggggccgagagaattttggaaagtcaagccttctcttggctgccggcttaaataaaggactcttaattcgtctcgaagt

SEQ ID NO: 100146 - DNA, 308 bp, Homo sapiens
ggagctcggtcccgaatctcgacagtgtgcagaaagtagtttcctaaactttaaattatgtccttaggacaagatttcagaagcagatgacagaatcagggagaaggaacattttaaagactcttgacgtctattgccaaatcactttttttcctcatactagaaatagctttaaacataaaacaatcattgctttaggaaggtttaaagagattttgaaactctactcttatcagccacctccagaacagtctcaaagcacaggctttggagtcagccagcctgggttcaaatctcagcttccccac

SEQ ID NO: 100147 - DNA, 376 bp, Homo sapiens
ctttttctttgagtcagggtctcactctgtcacccaggctgggcctggtcagcacccatgctatggagagctcttcatggtctggtgtggacagagtgggagtggaagatctcctcccacacaggtgctcagtgtcttacctcacctacgggcagcagctgtcttcacctgagtgtgtgcacacaggtgtatcagccccatgggcagtgatggacgagggctgaggcactcacagggcagcccatgccccggtcaggtccagtgggggagatatcaagaaaacccagcgccaaaatgcaatgagctgtgatcgcgctactgcactccagcctgggcgacaaagcaagttgccgtctcaaaaaacaaaaacaaaact

SEQ ID NO: 100148 - DNA, 374 bp, Homo sapiens
tccacattccgtctcccatttcatcctctcagagctgtcctctgtgcttttcctttgtaattcttgccactatttactttccttcaaagcaaaactgccaccaagaaccattaagatgtgtagcctccacgtcctcacctcgctggctcttcaactcactcccattgggccaccgcaccaacactccactggaaccacccattgaggttactaatcagttgaccaaatccaacaatgacttctccgtcctcattttatccaacttcccagtaacctttgtgataccctctgtgaaaggaagaacaggaaccccaaagatatacacaccctaatccccagaacctgtaaataaataacatcacaaggcaaagggg

SEQ ID NO: 100149 - DNA, 151 bp, Homo sapiens
ctgccgcaactccagcctccccaggctgcctggctgggggctttctgtgacactcattcgccttgctacaacctcaacactcatcttcaccttctttgtcccctagccctaaataaaaatatattgtttagcatgttcagaatgctttcat

SEQ ID NO: 100150 - DNA, 335 bp, Homo sapiens
tactaaattcgcggccgcgtcgacgggagggaggcagggatcattgtgccctaactgttcagaccgttagagagtgtgcagagggtcaaccagagccaagtgcgtctggcttgtcaactcagcctcacaagtgcgtcctgagacccttcccaggggtctgctctggagaaatcaggacagccatcggcacttatctcgtcccttgggaggcaggaggagactagttatgagggtggtgagctgagacaggacgtggcctttggtaacagggccagcttgtgatgaggtcacatttgtctctgtggcacctccacctgagtcctctggcttaccca

SEQ ID NO: 100151 - DNA, 542 bp, Homo sapiens
agatgatgcaggatattttcctggtggtaatgctgagcagtgttaaaatctggggaagggaagagaagtttgagatggaactaaaggtgtgatggagaaagcagaacttccagtattcggttaggcaaacatgaccgcctggggctggcggcagaggaaggccaggtaagttgacactactgctgtttgtttagaagtggctggaaacaccaggggctgaaacctttgcagaaaacccttttattttctgaaatgatcactcagttcacgcaattccagtgttcccattgcaatgtttagctctcacttataagtgtacccaatatttagctctcacttataaatgagaacatccagtatttgcttttcagttcctgcattaatttgcttaggcctagttgagaagagagctcagtggagctcagctaaagtttggtcaaggagggagtctttatcagagctaagagggcaacccacttgggtccccttccacactgtgcaagctttgttcttttgcccttcacaataaatcttgctgctgc

SEQ ID NO: 100152 - DNA, 589 bp, Homo sapiens
ggccggcggcctgctgggggagggggccgcggggggcgggggagctcacctccgccattcttgtagcacaggctgcagccgtctcctcccggtgctcgctccttccttgagctctgtccaccgctgcccactgggggctagagcttcccggctaccctggaagctggaggctgggaccagctcttcaggtgacaggcctctgtgtctccacagtggccagaggggagcctgcctgactgatgagcaaggctccactttgtcaccaaggcagagaaggggcccggctccctgatctgatcgtggacactgcagtccccagatggctcatcccgttaagctaagccctcggccatccctccagctttaggaagaaaagcagttctggcccaagccagactgagcttcctggggtcttctctggcccagcctttgactgaagctggtctggagacaggggcgttagagaagtgactcatagatggcctaaataagcggggccactcaaggacccaggacagggggaagagggccaacccatctggaccgcaggcaaaccccatggcctttgagagaagagagaagaggaccc

SEQ ID NO: 100153 - DNA, 711 bp, Homo sapiens
tatctaccaaatcactttggatatataaggactcaaaattactcatgcaaaaagtagtattgggtaaaagagactgggaagtcttgtagtcacctgaatgtcacaattttcaaacattttggtgttctttctaaataaaatgtgtgtgtgtgtgcgtgtgtgtgtgtgtgtgtgtacatgtgagatgaaagcatcttgtatatatgagttagtgccaaatatttgttcttagaattttaatgtgagcattgaccagtgacaaatcccacataaacaccacttcagtggccgccttgtattctattatagggatctatgtcatttgtttcaccattcttttattctttgatgtttaggtttccaagtttttaaccattataaaaatgtgacaagcatctttgctttctttatgtccacacttttaattatttttttggaattgtgtctaagaaggaaatttcagattattttttatcctcttgatacatattgcaaaattactttccagaataagcttgtaaccgtttatactcccaccagttgtgtaggaagttcccacttcataacatccttgccagcatgggcactctcatttaaaaaaaaatattttacatttgaggcatagacttcaaagatgagagtcttagatgccatttagtgtaaccttttattcaataatttgtcctcccaatgctctaaccgtaaattcct

SEQ ID NO: 100154 - DNA, 717 bp, Homo sapiens
agagtcagaagacctgagctctagttccagaagaaagatcttggggaagtcattgcagggtaataatctagtcatttcagaataatctggggagagaataatagttttaaaataagggtggagtatgcatgactccagggtcatctcctgcccttcagtcctgtctcaactgaagcttcttttcactcacctgcttgatatgacaaaaatgatgaaaacatttattgccaacttcaggatggttgcaaaaaatgaatgaaataatgaatgtgaaattgtattcaaatattaatcaataacactgttgcttagaaacggatatataaaatagacaccaagatttatcgagatttataccgggaaatttaaatctgctttacggagaaagataaagcagttctaattaacatgttccaaagcaattcaaaatatctgctgtgctcttggccactggatgtctatttcgatagaagggtgcttagagtttttgtccagggtggaaaaaagaaaatagtatgtcctttagaattttttttagtcttctgggatctactttttgtaattgagagaccaaaaaaaaaaagatagatatttaaaacttatctttggaaaggaagatgaaatgtcataatgttgtcagtttttctaataataagtggtgtatcagatgcaatcttatttgaaactcagtgggatttttctcataatgtcatatat

SEQ ID NO: 100155 - DNA, 414 bp, Homo sapiens
tcccaaagtgttgggattacaggagtgagccaccgtgccctgcaattcttgtaaagtgtattgtaatggaaggaatgatagccttgtctctacagctagattatgaattaccagaatattgtgcttccagcttctagcatggtgtctggtgttattgtgataatagaaataaacatttaagtgcttactcctaagtgcttacctgtattttttctcaataatcttagaggtctctgccttacaggtgagataactgaatcattgagattaagtagttcacacggtgtatagtgctgtaattcaaaaccagactcaccccaaagccacttatgtttataccatctcccatagttgaatgaataatacaatttgtgtaacaatgaaacttttgaaaatcctggtcatttgtttctt

SEQ ID NO: 100156 - DNA, 690 bp, Homo sapiens
ctattacctcagggggatgggaagagagatggttataggaggtcgagattattaagtttttctctaccgatcttggcattatctctctggttacaataatatgcattgctcttgtaatttgaaaaaataataaattaaacttgaaaaacagaggaaatttttcccatcagaataagactgcaacagatgaagaaatagtttactaaatgtggctgagggtttaaagttgcatttgtgtacctggtgaataaatatgcctaccaagatcaaagcccatagagatgacatatctcttcttcttccagaccagactaggtcctgcaggatgttgatatttcagatcatcactctaagagcaaacattcatgcaagatatgaagaggacataattaccttagcagggaggggtctgtacaaactcctttgactttagagccctaagaatagaatatgttggaggcagattatctgtactacccttgaaaacaatgctctctaaaaccaaagtccacagtactgagtggattagccactataaattacctgtgcaggaatgtgtgtgtgtgtgtgtatgcgtgtgtgtgtgtgtgtgtgtgtgtgtagaaatgttgtgaataataaatatattgaaataggaattctgtgtacattaattttgctttaattctaccttctgaagatatctcatta

SEQ ID NO: 100157 - DNA, 378 bp, Homo sapiens
agtgatttaaaggagtatacaaaggaacaggataaaccatctaatttggttctgaaagataaagtaagcccaaataggaggcaaaatataatgttgtactagatgagcaggcagaagactccaagtcaagtcactcacacacaagtaaaaatcacaagaagaaaacccatcactgctctgaagtaaaagaagatgaagactacataccaatcaaaaatattaatccagataagtatgagaaagtttggagtttggtcactacgaagaagaagaaagctgttgggagaaatgaaagagtaaaaagagagaccgaactcagaactgaagtcgtagctgatcgcaagagaggaatggccattatagtaatagtcacaaatc

SEQ ID NO: 100158 - DNA, 325 bp, Homo sapiens
tacccagggtggagtgcaggtgcaatcacggctcactgcagctgcgaactcctgggctcaggtgatcttcccatctcagcctgccaagtagctgggactacagatgcacaccaccacatgtggctaatttttatattttgtagagacggggtctggctattttgcccaggctggtcccgaactcctggaatcaagtgatccacccaccttggcctcccaaagtactagaattacaggtgtgagccaccgtgcccggccctatgttatatttttgagaacttcctagctgtgaagtcattcttaagttcttcctaaataaaaaaaa

SEQ ID NO: 100159 - DNA, 403 bp, Homo sapiens
gctggctcctgggaccgcagcacagtgagcaacgcgcagctgctccctccctccgtgtccctcggccaccgcccttcactgctcccttccgtgtgatgacagcccgtttgttctcctgtctatgtgatcctgggcatgcgaccacgcgtccctgcccaacctggctcagttcagctggagacagggccgacccgcttgttggagtcgtcacgaggactgaggtgcgtcctgagatgcctgcttgccaggtgttagtgtcggtttgctggggccgcggtgacagagtgccatagaccaggcagctgaaacagagttcatcgtctctcagtcctggaggccggaagtccatgatcaaggttctgtcggggctcgttccttgtgaggacgtgagggcaatctggtg

SEQ ID NO: 100160 - DNA, 213 bp, Homo sapiens
agctgccccagtgagggcccaccctgccttcacctctgagggccaactaggccacagcccagtgattcttaacaatgcttccttttgcccccaccccagattggatgatttccaaatgacctgttttctagttcatcaatccttcttctgcttgttctacttggctgttgaaaccctcttttgaattgttattattatattcttcagctcaat

SEQ ID NO: 100161 - DNA, 482 bp, Homo sapiens
taaagcaactgtacagttgtcctatattctccaccttcccttggtttcatttctcttcgcttcctgaatgagaagtgcctgagataccttcatttctcttgaaagtattgatccaagtttagacaaatatctcccctcttgttgagagaattccttatatgtgaaaataccaagacattcttgatatttagcaggcactcaaatatttgtctcctcttttttagcataattaagccagactgatgtttgcatttgagtatcatcagcatgagtaaccattttaatctctcttcccttaactacttgttctacactagagtctagggtcagggtacgtacagtgataaagattgagataatgggaaatatagtcttctgtttgggaagctggattgtagtgttgattttctgactccttgtggtaattaaattctgaagcacagaatctacttttgagaagaaatattttacttttgaaaaaa

SEQ ID NO: 100162 - DNA, 283 bp, Homo sapiens
acaagtaagaaaaggcatttttactcggcctggtggcttatacctgtaatcctagcactttgggaggcctaggcaggtagattgcctgagcccaggagtttgagacgagctggctcaacatggcgagaccccatctctgaaaaagaaaaggcatttcatttggagagaacagtacttgcaaaggcttggtgaggatgtgagaggaaaaaaaattattttaaatctcagaaatttgtcccaaacaggatgtgtggtggggaaactgctaggaggtgagactgaa

SEQ ID NO: 100163 - DNA, 419 bp, Homo sapiens
tgagacagtcttgctttgttacccagactggagtgcagtggtacaatcacggccgactgccacctcgatctcccagcatcaagcaatcctcccacctcagcctcctgtgtggctgagtctgcaggtgcatgctgccatgcccagctaattctttaattttttgtagaaatgagggtctccttattttttgtagagatggagtctcatcatgttgcccaggctggtcttgagctcctgggctcccccttttggcctctcaaagtgctgggattacaggtgtgagccaccacacccagccagctatgtgttttttaaagatgttacagttaattgtaaaatactaacaaatatcttgatttaattatctcatattttctttttaaaagcttttggaaatatatatagtaattttaaatgct

SEQ ID NO: 100164 - DNA, 348 bp, Homo sapiens
atattcaacatacttggtatattccaatctattgcaatgatctttgttgaggctcaaattgttccatctttggccagtgggaatctctctttgtgatggtttctgagtccttctgacataatgcctatactctttgatatgttccttgctatctggtatgacaagatgttccaggctcatcttgaacatttcctgctcagacctggaatcagccatttctccacagagccgtttatttttaaaagtaataaatggtattttaagaccacaaactcggtgctagggatacttattgttttcaggcctttcagtggacacagcgaggaaacatatatatatatttaaaga

SEQ ID NO: 100165 - DNA, 116 bp, Homo sapiens
aatgttctttttgcttttaacaaggaagaaaagggatgcatcaatcacgactctccttcctcccctaaaaatactgaaatacgaaacaataaaatttgaaattagagctgtacaaa

SEQ ID NO: 100166 - DNA, 258 bp, Homo sapiens
gctaaagacccgactcccacccctgcccccgcccaggccaggcttcccgtagctgacgcagatcccctcgaggagggtcaaggggcggccagggtatggttgtgggagtgcccctcctctgttcccgccccggaggagaaatgagggtggcctcccaagaaatgacctccaccccatgacagcagaacagggcagcccccttgtgtggaaggaaggggacccctgggagcccctttcttccagagagtctctctctcc

SEQ ID NO: 100167 - DNA, 436 bp, Homo sapiens
  misc_feature (49)..(49): n is a, c, g, or t
ccaaagtttcgctcttgttgcccaagctggagtccaatggcgtgatttnggttcaccacaacctccccctcccgggttcaagcaattctcctgtctcagccacccgagtagcttggtttacaggcaacagcaggccaaaggttttacaagtctggttacaaaatccaagtccacccagaccacagctgaagatgagtgtaacccagaactgaacattcataaacactgatgaagcagtgaggattaaaaagggtattttagaacaatatgacaatcctgaaagatagctgaatcctgaaagatccctcacatacggtccacacatacaatcctgaaagatgcctcacatatcaaatgcaatcctgaaagatacctcacataccaaattcacatgattttaagaccagtaaaagaaaataaaatgttatttcaacag

SEQ ID NO: 100168 - DNA, 397 bp, Homo sapiens
tgagacaaagtcttgctctgtggcccaggctggagtgcagtggcacgatctcagcttcctgcaacctccacctcccgggttgaagcaattctcctgcctcagccaccaagtaaatgggattacaggcacacgccatcgcactcggctaatttttgtatttttagtggagatggggtttcgccatgttggccaggctggtctcgaactcctaacctcaagtgatctgcacgccttggcatcccaaagtgctgggattacaggcgtgagccaccacacccagccaacaactataaacttttaatagcatatattcactatataagcctaccacaatcacaaaacataaatatttttcagaataaaattaaactagcttctagggaaataaaactatcat

SEQ ID NO: 100169 - DNA, 632 bp, Homo sapiens
tgcagtggctcacacctgtaatcctagcactttacgaggccaaggcaggcggatcacgagatcaggagatcaggagatcaagaccatcctggctaacacagtgaaaccccatctctactaaaaatacaaaaaattagcccgatgtgctggcgggtgcctatagtcccaactattcgggaggctgaggcaggagaatggcgtgaacccaggagggggagcgtgcaatgagccgagattgtgccactgcactccagcctaggtaacagagcaagactacgtctcaaaaaaaagaaagaaagaaagaaaaagtagaggaactaatctgagtcactaaatacaaaacagtaaggtaaagcagtgagaaaggttagggagtaaactattgttgccttttttgcattatttttcttccatccagaaggaaaccaacccctgtaacttcaagtgtaattcattaccagccaaagcagtggcttgtgcctgtaatccctctgctttaggaggccaagggaggaggactgcttggagccaggagttcaagaccagcctgggcaacacacagagacctgcctacaatgcttttgaaaattagctgggcattgtgatgtgcacctgcagtcctatctactcag

SEQ ID NO: 100170 - DNA, 798 bp, Homo sapiens
ttctgtccagtaacagctctcatttcttgggcacgtattttatgccaggcgctaagagatgcaatgcatacatctcatttatcctcatgaccaccctgggagttaaatactattattttccccactttttacatgaggagattgattatttaaaagacagagcaactgcctgaggtcacacatcttgcaactgatagaactgggatttgaaccatggattctagtgttaaagctctcccctagccctgcagtgatcatgcttccagagattctgagatgaaaatctctgcaatgggtctggagaaagtatgggtatgtgtttcttgactttctccaatctgatttcatgtttctgtgttacggaaattacaatgaaatgaaggtcattacactaagaggttgatctgaataggcatcccattccaaggtgtatatcattgtccacagctataaaaagacattccaatacctgcacagtgacctaggagcttttctctgaggactctttggagagagatttaaggaagagactaagaacagctgttttttccagtattaggatatagtcctcgagatgaactgtcaactagagaaatcctagctcaatttgccttttagatctgaaaacataacttcagttattagcactattaaatataatttaacctcattgacatttaaaaacagaatgaatttaatattcactaagtataaactttttgttgtaatataacactctaagcaatatgataaaagataccaaccatcctcctcacattccctgatagttatttatgg

SEQ ID NO: 100171 - DNA, 514 bp, Homo sapiens
tcacagaccggaaaactgaagcccagggaaggcaagtgacttaggcaagatcacacaactgcctcccaggcaaaccaggaaaagaaacaaaatcacagatacttgtgctaccaaagaattattcttgttaccccaagttttgatatcccggaatgccaaagagttttccccaagagcatcattcctgggctcagcttgcagtttgaccacctggatcctgtcatcagcatgacccggggccgtggtccttcttgggaggtgtcatgacatcacagggaaaagcataggcttctgacgtcatgatataattcctggttcctcagtttactagctggatgacttgaaaaactgctcaacctctctctggcctctatgttctcatctataaaatggaacccacctgacatgacaacctcacagaactgttgtgaggaactaatgagattatgtaactaacatgcttgctatttagaaagtgttccattgttttggccaggcacggtggctcatgcct

SEQ ID NO: 100172 - DNA, 520 bp, Homo sapiens
atagtcctatctctcccctcaaaattaagtaattctttaacaaataactttaaccggtacagtcctacctcaggggtttagaaatagcccacatttattcagacaagttctagtgaaaatctaactgagcaaactcttgagcgggggataacttctgcagtaggtagataacccccttatctgctccccctccacaggactcacatagcaacatgtggtacaaaccttaactttctaaaagaaggaaaatgacttttgtctaattcaaaggttataaaggtaaagtggtatttctggtaaggaaggctataaagaagagatattgtagaacaaaaaaaaatcttgtatggtaaattcttgtcctaaagtaaaatgactggtggtttaaaaagagggatgtttaggacaagtaaaaaagtccaagcatgttgtaggtggtctgtgtaagttgttaaaaaagatttgtgaaagggaatttatgaaagaactactacacaattttaaaggttactatgccatc

SEQ ID NO: 100173 - DNA, 798 bp, Homo sapiens
ggtgagtttggctacacccatcctgtatttcagtgagtcattttggatctgaatcttctctgtttgccgagaatgcctggtgtaaatatgcatcctcaccaagtactctttggtaacctgacagtgctctagtggtagatccaggccctaagcctttccagagagaaagtatttcttattcttctgggaagatccagaacaggggaaagtatgagactttttaccttttttctgtttaaaaacatattttaaaattatgtaaataatacttggttgttacagaaaaagtagaaaatgaagaaatttatcccaaactttattaaccagggtaatattgcttagtatatactcttttttcccccctactgtctgtgtaattgcagaaggtacatattcttacagatttttttctgtgttttcacaaacacatatacaaatacagtttttgcttttctacaaaaacagtttatattgttttgttatctgttgtttttcctctcatttaataattatatcagaggttgcggtgagccaagatggcaccattgtactccagcctgggcaacaagggcgaaattccatctcaaaaaacaaaaaaaaaggatcatgatgaacgtatagtattgcaatttgcttagtgagacattatagacatctttctatatcaataaggtatctatattatcattttaatggctatataatgccgctctattctactgacatgtacaatttattttaccaaacccctattattgaatattgaagttatttctaatatattgataatataaaaca

SEQ ID NO: 100174 - DNA, 102 bp, Homo sapiens
cagcctgggcaacatagtaagaccccatctctacaaaaaagagaaagaaaaaaattagtggggtgtgatggtgtgtgcctgtggtccctgctacccaggagg

SEQ ID NO: 100175 - DNA, 570 bp, Homo sapiens
cttgaggacccggtcaggaagagagaactgttaggtatcaagtataggcctttcatggaggctgtaatcaaatacttggaatgcggcaatagttacattaaccagaaatggaaatactattcctatcatcatatacatgtgctgaaaatactgctttcttttctttattttttaagacggagtttcgctctgtcgcccaggctggagtgtagtggcgagatcttgggtcactggatgctcagcctcctgggttcacaccattcttctgcctcagcctccccaaagtgctgggattatgtgtgagctaccgcacccagctccccaactttgtttctaaaaggtttggctattgttggttttttgctgttccataaaaattttagagtgaaatctggcaaatttcaacaaaagctgtcctgaaatttttattgagattgccttggatctgtggatgcatttggagagaatgaacatctttaatgtcaattcctgattatttcttgctaatatagagaattgccattgttcacttatctcttgaacgtgtagtttaatccagctagtcaaagc

SEQ ID NO: 100176 - DNA, 448 bp, Homo sapiens
tttttttttgagatggagactcactctgttgccaggctggtgtgcagtggcgcgatcccggctcactgcaacctccacctcccgggttcaagtgattctcctgtctcatcctcctgagtagctggcactataggcatgcgccaccacaccaagctaatttttgtatttttagtagagacagggtttccccatattggccaggatggtctcgatctcttgaccctgtgatccgaccaactcacccggcctcagtatatttttaaaacagagggggaaaacaccaaagtggcccaggttggagtgaaagcttttttcactgagatggcctcacagaccagcacacaacatggagtcccagaggtcttcagaccctggctgaaagctgctttctctatgccaatcaaatctgtaaagtacaagatgtcctgtacccaagtggagatgcttt

SEQ ID NO: 100177 - DNA, 651 bp, Homo sapiens
cctgaggctcacgggcacagccgagcgccgtgctccgactgggtggtctaggaactggaggtcaccgtaggcagggtttctctctcacgtggctcctcctgcctgaagcctctaggagcccgagatggagggatccttctgagaagtgaagccatttggactttctgggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaacttcgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatagc

SEQ ID NO: 100178 - DNA, 190 bp, Homo sapiens
tctctctctacagatacatcagcccacagcaaggcgggctccagcagcccggagccatgggcccggccctcctgcactccccaggaagggggctgcccacggcccaaggagcgtgagtcaccacccccttcggccctgcagccggtccagctgcctcgcctggccttgtctccaccacccccagcccctc

SEQ ID NO: 100179 - DNA, 725 bp, Homo sapiens
gggtattgcagacatcagagcatgtgacttacgaggctagaccataaaaatattgaggcttctgccttactgatgtggatcattcactctaggaaaagccagctgccatgttgggaggatactcaagcatacccgtgtagaagaactgagcctcctgccaacagccatgtgagtgaaccacgttcgaagttgattctgcagccctagttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctacccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttggggtttcaccatttaacccagttaactcttctataagtgccgtattaaag

SEQ ID NO: 100180 - DNA, 542 bp, Homo sapiens
cggcacgaggagcggcggcaaatgttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctacccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttggggtttcaccatttaacccagttaactcttctataagtgccgtattaaag

SEQ ID NO: 100181 - DNA, 561 bp, Homo sapiens
gttttatttagtacacaggcaagcagcataatccagtttgtattttagaaagatcatatcagttgctgtatggaaactagattggaagggccaggagaggacccaaggaggccattctgttatttagggaagagatgatggtggtgtggatcgggttgtggttggtggaggaggagagaagtgcacagattgtagaagtgttttataagcagtcaagatttgtcgatggagtacatgtgggcagtgctcaagattgtgtcccacatttctttttttcttttttttttttgtttgattgggatggagtctcactgtattgcccaggctggagttcagtggcaccatctcggcttactgcaacctccacctcccgggttcaagcgattctcctgcctcagcctcccaagtacctggggctacaggcgcccgctaccacacccagctaatttttgtatttttaatagacatgaggtttcaccatgttggccaggctgttctcaaactcctgacctcaaatgatctgcccgcctcagcctcccaaagtgctgagattacaagtgt

SEQ ID NO: 100182 - DNA, 769 bp, Homo sapiens
caacagtgtgcaaacctgtctcaaaaattaaataaataaaatgactggtaataagatgtcaatatgatgcacatcacttttgtgatattctttccaaaaatatgtaacctcattctaatcataagtatcagacaaacccaaattgaggaacaatctagaaaataactgatattcctcaaaaatggcatcatcatgaaaaataaggaaagactaaggaactctcatattggaagaaactagagagacaaaacacatgtaatgttgaatctggggttggtgaaatgaaagaaataacggaaaaatgatatcagtggaaaaacggtaaaatctgagtaaagtccataatttagtgaatagcatcgtgccagtgttaatttcttagtactgatcattgtactatttgcaagctgttaacattaggggaatttaggtcaaaggtatacaataactctactatttttgcagttttttttgtaaatctaaaactatttcaaaacagaaagttaaaaaaaggaaattaacagtacaggtattagaagtacatgtgggagaattataatcccagaggtaatgaaggcctttctgagtatgacatatccagaagaggttgataagaataaaaatctctacatgtaaaaataatttccaaaacaaagactcatgtaaaactgaaaaaacatatgcaaaacctgacaaatgaaacgctggtttctttaatgtatgaagcgcttatataaataaacatgtaaaggaccagccagtaaaaaaa

SEQ ID NO: 100183 - DNA, 274 bp, Homo sapiens
ggagcctagggagaacctggtaagatggcaccaagttgacaccataagggactgtgagggtgaagccacctgggaaggaagaagagaaggaagatgccagacagtcctggaggttaggcaggacttaaatgactttgagactggtcactcatccaaatatgaaaactctcgggactcagaaaatgataggactaagcaaaaatccagcaccagggcgggtggctcatgcctgtaatcccagcactttgggaggccgaggtggatggatcacctg

SEQ ID NO: 100184 - DNA, 733 bp, Homo sapiens
gaagccttgattttgtatgtccatcttgagtctaggtttggttgccttacttgtattgcatctaataactttgtactgatatttttattttattaaaactgatatttctagataatttttttcttttaagggatagggtcttactctgtcacccaggttggagtgcagtagtagcatgatcatagctcactgcagcctcctgggctcaaacaatcctcctgcctatagcatcccaatgtactgggattacaggtgtgagccaccacgcctggactcttttagttatttttaccacagtaatacatgcaggcagttttagaagtcaaagaatatgacaagatttaaaatggaaaaaaaattagcagcacccatccatttcctccctatattggtactgttgaggatggcagctagtagccactgtggctcttgagcacttgaaatgtcctttgtcctaactgagaagtattggccaggagtggtggctcacacctgtaatcctagcagtttggaaggctgaggtgggaggatcacctgagcccaggagtttgagaccagcctgggcaatatagtgagaccctttctgtatttaaaaataaataggctgggcacggtggctcatgcctgtaatcccatctctcagggaggcagaggcgggaggatagcttgagcccaggagtttgagacctgccttgggcaacatagcaagactctgttctccacgaaaaggaag

SEQ ID NO: 100185 - DNA, 772 bp, Homo sapiens
gacttcttttttgttgttgttgttgttttgagagggagtttcgctcttcttgcccaggctagagtgcaatggcgtgatcttggctcactgaaatctccgcctcctgagttcaagcgattctcctgcctcagcctccctagtagctgggactacaggcgcccgccaccacacccggctaattttcatatttttagtagagaaggagtttcaccatgttagccagtctggtctcaaactcctgggctcaaacaatcctcctgcctatagcatcccaatgtactgggattacaggtgtgagccaccacgcctggactcttttagttatttttaccacagtaatacatgcaggcagttttagaagtcaaagaatatgacaagatttaaaatggaaaaaaaattagcagcacccatccatttcctccctatattggtactgttgaggatggcagctagtagccactgtggctcttgagcacttgaaatgtcctttgtcctaactgagaagtattggccaggagtggtggctcacacctgtaatcctagcagtttggaaggctgaggtgggaggatcacctgagcccaggagtttgagaccagcctgggcaatatagtgagaccctttctgtatttaaaaataaataggctgggcacggtggctcatgcctgtaatcccatctctcagggaggcagaggcgggaggatagcttgagcccaggagtttgagacctgccttgggcaacatagcaagactctgttctccacgaaaaggaag

SEQ ID NO: 100186 - DNA, 588 bp, Homo sapiens
tattgatttttatgccacaaattccatttttatttatagtgtgcccattaacatagatttatgatgactgttttgtttaactgtttttttaaaatcaagaaggacaagaaaaagaattacaaaccgaaattatattaatactgaattttatatttacctgtgtagttgccttttgtgtggattgcctttattcttttgtgtggatttcagctacagcctagtgtactttcactttagtttaaaggactccttttagtatttcttataaggcatatctaccagaaacacacttttagtttgtgtgtctgtgggaatatcttacttccttcttcatttgtgaagtcggttttagccaaatacagaattctttgttgattttttttttcctttcagcgctttaaatatgccttcccacagtcttctggctttcatatttttttttttttttttaatgagaattcagctgttaatcttatggtgaatcccttgtatatgatgagtctctgctctcttgctggttttaggtttctttttgggtttattttcagttttgatctttttgcgtttatgcaccttgacattaattaa

SEQ ID NO: 100187 - DNA, 342 bp, Homo sapiens
tccatttgatcaaactttacgatctaaggagaaaacacacaacttacatttaactgttttcacattacataagctgcttggtctgaaataagctactccaccattgctggaagctgaaaatctgctgaagatacagttggccctctaaattcatggcttctgcgttgagtgatctctgctggattgaactggatgcagaacatgtggatatgcagggccagctgtgtttttgatctgcagttgttggaacctgcagatgctggacctggggatttataacccagcgataccatgggctgactgtaagagacttaaacatccacagatgttggtatttgtggg

SEQ ID NO: 100188 - DNA, 484 bp, Homo sapiens
tggaagacagtttccttgttgcccaggttagagtgcaatggcacgatctcagctcactgtcacctccgtctcccagttcaagcaattctcctgcctcagcctcccaagtagctgggattacaggagtgcaccaccatgcccagctaatttttgtttttaatagagatggggttttcaccatgttggccaagctggtctcaaactcctgacctaaggtgatccgcctgcctcggcctcccaaagtgctgggattataggcatgagccaccaaacccagcccatgaaaaacatcttgataaatgtctagtcatgataaaaaaaaaaaaaaaaaaccttagaagcaaactagaagtagaagggaacttgctcaacctgataaaacagcatcaccaaaaatccccgtgggtaacatgatacataattgtgaaagcaagaaagctttccccaagagtgggaatgaggaaaggctatagactcttaccat

SEQ ID NO: 100189 - DNA, 804 bp, Homo sapiens
ggaagtactttttttttttaaatcgacttgtgcctcaatatactttttttttttttaaggaaactattgcttgggaataattttcagtttacagaaaaattgcatagatagaaaagagaatattcatggtacccacacccagtttccctgcacattaataactgatgactaaactcccaggctttatccaaatttcacctatttttctgctccagaatccagctcaggctcccacattgcacttggtggatttaacttttgagccaccactcccagccccgtttgtttcttgaatagtcctttgcagaaaactggagacttatggactaggggcccagctgccttcaaaagatgtttggggtccctttacaagtgagaggctatataggaatctgcaatttaagacaggcaattcttgcttacaaattggcatttctggaagtcagtgtgcctctagattatttataaaggacagtttgaaaccaattaagacagtcacttaatatgtcatatcaggtccgggtacactggcccatgcctataatcccagcactttgggaagtcgaagcgggaggatcacttaaggctaggtattcaagaccagcctgggcgacataatgagacccccgttgctacagaaaaattttaaattagctgggcatggtatcacacacctgtaatcctagctactcaggaggctgaggctggaggatcccttgagcccaggaattggaggcttcagtgagctgtgatcatgccactgtactctagcctagatgatggagcgagaatgtgtctctcttt

SEQ ID NO: 100190 - DNA, 434 bp, Homo sapiens
ggtgatctagaggatcccaatcagtttacacaaaaaagaaatactaagtcctcaggacacagcctggaatgcaagaagcactcaataaatagtacctgttgctacgaattaccacatttttttaaatggtattttgggggtttgacgtgtagtttggggtaggaggcttttcgttttgttttttgtttttggatagtaccaggtttgggaagaatattctgagtcatacttaccttctaagctgcaagatgtcttttttaatttttctttgtcccctgaggtgcgggatgaaggggtttttttcttcctcctacctttttattctttttaatactgtcttgcttgtgtaacatcaaaatgaggcaagaaagagaaatcaatgaagtcatcttctcatcgatttagtctattcccaggtggccgaaaaggcagga

SEQ ID NO: 100191 - DNA, 879 bp, Homo sapiens
gccagtgcttgctagaactctctagagccaggttgcactctcagcctaaaagaaaagtcttggctgaaacaaagaacagaaggatgggtggggacagaaaacctccctaaatgtgagaaaaggagtcattatttctgagaccaggccttgaaaccgaggtgcttgtctggttcacttgtttctttctttttgtttttgtttgttcagagacagggtctcactacgtcgcccaggctggaatacagtggtgccatcatagctcactgcagtctcgacctgctgggctcaagggatcctcctgcctcagcctcccaaagtactcagattacagacttgagccaccactcccagccccgtttgtttcttgaatagtcctttgcagaaaactggagacttatggactaggggcccagctgccttcaaaagatgtttggggtccctttacaagtgagaggctatataggaatctgcaatttaagacaggcaattcttgcttacaaattggcatttctggaagtcagtgtgcctctagattatttataaaggacagtttgaaaccaattaagacagtcacttaatatgtcatatcaggtccgggtacactggcccatgcctataatcccagcactttgggaagtcgaagcgggaggatcacttaaggctaggtattcaagaccagcctgggcgacataatgagacccccgttgctacagaaaaattttaaattagctgggcatggtatcacacacctgtaatcctagctactcaggaggctgaggctggaggatcccttgagcccaggaattggaggcttcagtgagctgtgatcatgccactgtactctagcctagatgatggagcgagaatgtgtctctcttt

SEQ ID NO: 100192 - DNA, 813 bp, Homo sapiens
gtgagccgagattgcgccattgtgctccagcctgggcaacaagagcgaaactccagctcaaacaaaagaaatactaagtcctcaggacacagcctggaatgcaagaagcactcaataaatagtacctgttgctacgaattaccacatttttttaaatggtattttgggggtttgacgtgtagtttggggtaggaggcttttcgttttgttttttgtttttggatagtaccaggtttgggaagaatattctgagtcatacttaccttctaagctgcaagatgtcttttttaatttttctttgtcccctgaggtgcgggatgaaggggtttttttcttcctcctacctttttattctttttaatactgtcttgcttgtgtaacatcaaaatgaggcaagaaagagaaatcaatgaagtcatcttctcatcgatttagtctattcccaggtggccgaaaaggcaggaactgtgaactgaaaacttcatctggcatcagattttctttaattgtctctcgaacactcaccagtaagccagtgcttgctagaactctctagagccaggttgcactctcagcctaaaagaaaagtcttggctgaaacaaagaacagaaggatgggtggggacagaaaacctccctaaatgtgagaaaaggagtcattatttctgagaccaggccttgaaaccgaggtgcttgtctggttcacttgtttctttctttttgtttttgtttgttcagagacagggtctcactacgtcgcccaggctggaatacagtggtgccatcatagctcactgcagtctcgacctgctg

SEQ ID NO: 100193 - DNA, 599 bp, Homo sapiens
tacggtttggggccatgataggagatcaaaatgcgggtgaagacctagaaggcatcagaaaacagacaaggaatactttttagggtggccttattaacatctcctgaagaaggaagtccccagaatacagatttagcatgatgatgctcctgatcaagcatcccctttggctcagcccccaccaaatgccctgagaccactctcactcagcaagctccttcctcagctcctcactctcccatctctgaagacatcagatcagggccaccatggatcagtcccttcttcttatgtcagagctaatgagggcgacgtcaacagtcatagggacaggtagattcacactctgcctggaccaagaacgtcctggccactctccagcctgcacttcagagactgaccttgaactcccaaaccccatggcctaaccaatcacccatacttgtctgtcccgctggccagcactgttccctcaacctcaactgggatgctgctgcttctcggcaatctcaagtcccccagcccttccttctcctgtcttcaccttctcagccctccctgcttcagttcccactgcgttttcttgtaacaagctgacc

SEQ ID NO: 100194 - DNA, 240 bp, Homo sapiens
ttgatgatgtgatttgtaagaggctgtttctggaacaacacgaagaattgtgctggagtgtgagcgtggtgtgagctcaggtagaagggacttgctaagctccactcagggctctccacagcctcaccccgagtggagagatcactgtgcctcccaaccttagtgcagctcctttggggagctggggactgtagagaagccatgctccccaaatattgcctgctgatagctcctggtttg

SEQ ID NO: 100195 - DNA, 391 bp, Homo sapiens
aatgaaaagacacataaaaaaccactaggaaatagtaaagtctcaattttctgccatatctagaaaactgtgtccccctgcttaggttggcaaaacaaggtttgaaattactttacaccagttagattcctttccagattaaaacaaacacaaaataaagaaatttggggccgggcgcggtggcacatgcctgtaatcccagcactatgagaggccgagacgggcggatcacgaggtcaggagatcaagaccatcctggctgacacggtgaaaccccgtctccactaaaaatacaaaaaattagccaggagtgttggtgggcgcctgtagtccctgctactctggaggctgaggcaggagaatggcgtgaacctgggaggcggagcttgca

SEQ ID NO: 100196 - DNA, 400 bp, Homo sapiens
  misc_feature (323)..(323): n is a, c, g, or t
ggactttgaggcactgctgtaaagaaagtgcaaaaatcaacatattcagatttgtgccaaagaaagacttgagtttgagaacatttacatctgttttcaataattcctcgcatatgttgcagaatgtacgttatccatcttgttatccaggaaataacatttgttgcaaacagtttgccaattcgtaattttattgaatttgtttatcatgctgtggcttcatatgaggtctgaaagatggtgatctttggtgttccagctgttgtaacattctgcagtggggccttaattccaggatgagctggaattctttggagggtctngggctttctgagaactacagcataagagccggcattgctgaatggggcaattatcctttgggggaacgcagtaaact

SEQ ID NO: 100197 - DNA, 218 bp, Homo sapiens
ctgctcacgagccacagtacaatccgtatcgtcaccttttttccccaccctaattgtaaatttgtgaaatagcacaaagccaagttgaagacaatatcttccctaataacagtagtgcaatgacagccagccagaaaagttctccaccttggcagcaatgagactaagacttttatgcctgaattgctatcttttttttccaggtcagtaaatttctt

SEQ ID NO: 100198 - DNA, 724 bp, Homo sapiens
atccttgattgaatattggggggcagggaggagtacattaaagggtacctaaatactaggaagctaccttggaggctgactaccacatgccctctatcccattttgaatattaagctttcaaatgttgtaattatttaccaggctcggtagagtggctatagaatacagaagagatggatagaaattacacatttgatttagatgagtccatgtgagtgggccatcttgaaagtggatcctccagcccaagtcaagccttcagatgcctacagaccaagctgacatctacttatcctcaggagagatctcaagccaaaaccacccagccaaactgctcctgaactccgacatgcacaacccgactgagacaccactatatttaagataaagaaatcagacaacttgaagcatacacaaaaccagaaggcaatttaacatatctgcctggaggcaagaagagaaaccaaagaacttctaacacctgttcttctagctagaaaatagagaagagatgacaatattaacaattgcttgccagcttcaaattcccacaaatttatgaatatgaagccagtttccaaaagaaaatatagttcaataaactgtgtaacatatgatcactaaagtgatcttttaccttaatgatataaaaataagccattaagaagttctaaaacccaaatgcatcaacactgatggcaattaaaaattaattactgaacc

SEQ ID NO: 100199 - DNA, 299 bp, Homo sapiens
gagagggctgaaattgagaagagaagagagagaagtatgaaatgtcgggaaatatcagtgtttaatggagagagggagaaagaggaatcaaaaaagtctgattacaggccgggcacagtggctgacatctgtaatcccagcactttgggaggccgaggtggaagtgagccaagattgcctttgctctccagtgcatggctgacatactgagactcctttctaaacaaaaaaaaaaggcggcggggggtggggccacgccctgttgtccccccacctttttgggaggcccaggggggaag

SEQ ID NO: 100200 - DNA, 377 bp, Homo sapiens
agaggttttctctctgaaatcatcagggaaaacaaacaaactcaaagggcaaatgtgtgcatagcaaaagggaagtcgtggaaagaggtctgtggcttgtgcctttgagagctggcagaatgagtgagcagcacaggcttggtgagtgttccaaatttattcagagatccctcagatttggtttggtatgtatgggctctttttattacttcctttgttagcggttcggtgttcaaaagtttcaaagagtcgccacagagtttcttcatcattcttggggagccaggcaggtgggcaactctttctcttaagcagccatctgaaagacctcttaagcagccatctgaaagaccttacctcaggattacacttggaga

SEQ ID NO: 100201 - DNA, 536 bp, Homo sapiens
gtccccaccactgcagacacaggaattgggcagcaggtggagagtctggttgcctgaggcagccagtgctgtcctaggtcatctgtgagctctttatgctgtcccagagtggaatgcaagaggtggccactgagagtgggggaggagcaggcagcccaaggcagccgttcctgtttccctccagaggtactctatcagagccagcccaccctcagccagccacagagggccgtgctataaacaacacgtggcctgttgtgagagggtggcccgtattatggtgcaatatggggaggatatgtcaagcaaaagctgaactttctccctgcaacctccatccagaggtgaagaactgtggggaaactgtggcctactttttgaaggaatgcttcaggttagtggagaaaaagggtagtttgggctcattgcttgcatggaaggcccttgtctttcagaaaatgctgcaatgtctaatcctaaatttcttctgtagaaacttttcctaaattcagatttccttttcctcctggaatctt

SEQ ID NO: 100202 - DNA, 491 bp, Homo sapiens
ttgagattttttaaagcagcccaactgatgctaaggtacaggcgaatttggagtagtactgatttagaaaatagtctgaagggtacctgtaaatgatgaataagtaataactagatgtaaagtcacatcacagatcaatagagtccagctctaattcaaggtgtgaaagaactgtcaagaataaggacttaaaatagttaaaccacgtaagaaatgatgtagtaacatgtgttactagatcatcaggacaacctccatcaacaggacaggaccaagaattactactgaaattattggagaaagatttgttgagcaagaagagtcctctggaccacttacagtgtttagagatttttcttcgaatcaggaggtagtaatttctaattctatatgggaatatattgtttatctgtctttaaactacattacctaattcaaatcttccaacagccccagggaaaataggcaaagaaaatgcctgttccataggt

SEQ ID NO: 100203 - DNA, 534 bp, Homo sapiens
caaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatggtt

SEQ ID NO: 100204 - DNA, 286 bp, Homo sapiens
tccccgcactgacgaggctctgggtacagggacccttcgatggcccatgtggcgaaaaagaggctgcgggggacagacacgtttcccaggctaacgtctgcccaggctatgcagaacagccgctcccgtccaagccagatcctggctggagcaaggagggcgcagcggtcgccagcgcgggccccgaatcctcgacgccggcgccccctggtgttcctagcgccgcggccactggcacccgcgggaggcggaacccgggctgcgggtggtggcaggaccagggagg

SEQ ID NO: 100205 - DNA, 631 bp, Homo sapiens
cttattgcctgcaaagctgcctgaaaaagtagtttctcaagaaaagcagtttctcaagaaacatttcagtaataaatgaatgagtgaaatggtgtgtaagccataaccatcttagaaacagctgtgaaatcaagcatgctcgctgggagatgtggctcctctccgcggcacagtgtctatatcactgatcaggtggacagatagtcccagaaggaggccctcaccaacccatttccccagacacagtcagaactggggtcagctgcagagatgggaaccgcaagaggaaggagacccttaacaaggaccaggaaagtggtgtatgcataaagaaaggaagctgttcttgaaatgtgccagtgacctcatccctgtccctgaggccagcatgagtgcttgcagtgcaagtgacccatctgccagggtgacctcaggcctcggactaacagcaaataaagccatgaacacactgttctctggacacttttgcaatttttcctttccagggcctacagctctagacttgagacctgcaactcttcccctttgttcactatgactctaacaaatttaaaacatgtcagttctctccaaccccaagaaatgtgaataaatgtttccgaaaaccaga

SEQ ID NO: 100206 - DNA, 133 bp, Homo sapiens
agaactataaccttccccaaactctattgctgaggaaattgccttttagaacaggggcctggtatgtttttccataaaccacgaattattttcaggccaaacaaacctcatgaagacatatatgtttcacaag

SEQ ID NO: 100207 - DNA, 339 bp, Homo sapiens
tgtctatgtagagaagtggctagaagcttcttcaaattgagaaagaccaaagttctttattgtgtttggtgaaggagaagaagaaatattcctgcttccctggtcttaatattatcaaaatctctctcacagtttctcaacagcttttatgaaaacaaattcaaaatattggaagaagtgactgacacaccagatgtacagatattaatgcaaggacacaggaaatacaaaaaagcaagaaaatatgacacatcctaagggatacaataattatccagcaatagatcccaatcaaaaagaaattaacacattctgggaaaagtaatttaaagtattgat

SEQ ID NO: 100208 - DNA, 177 bp, Homo sapiens
tggttctggggccagacagctggggtttggatggggctgctgatgtctgcagttttctgcagtcacgccatcagtttcctggtctgtgcaatgggtattctaagccccagttcccgtcagtgtgttaggaagttcagtccaatgaagactgacaggctcctggctcctggtggcttg

SEQ ID NO: 100209 - DNA, 358 bp, Homo sapiens
ctacaaactaatgattaatgatatgtacatataatcatatctgtgatttatatctagtataactcttgttattacatatatcttattacactggaatagctcgtgctctcagtctcttgcctcggcacttgggtggcttgctgcccacagaagcctcattaccaggccaaacaggcagaaggttgagagccccacagcagggctgaacagagacagagttgagggcctcattgctgggctgatacaggcggaaggttgagagccttacagcagggctgaggaaagacaggagggtctggccatgatagctgttgatgatatatttcggttggagtttgctggtttggggaaagatcat

SEQ ID NO: 100210 - DNA, 179 bp, Homo sapiens
tcattaagttatacttttggataggaacactgaggaaaaatgaaagatgagatttgcaatagggattctctaattctcatgttaatctgttttgtaccatttttactttgtcttttgtggatctcttctttttattagatgatattaaaggggattaaagttgtattgtatgaaatgtc

SEQ ID NO: 100211 - DNA, 234 bp, Homo sapiens
gactctgaccaccccttggttctcttatcaaaaaccgccaaaacccgccatcgaaactcccagcctcctgacccccatgccccacccggctccacccgtcttcccaacctggcatccagtgccccaaacctgcctattccgttcctgggaagacccagaagggagcagagctggcaccaggaggccaacaacccaggccccctccgtccctagcccctcctggccctgggccct

SEQ ID NO: 100212 - DNA, 128 bp, Homo sapiens
cacgggtgctcaacagattgcttcctcctatcctcagacggtctttgcatgcatgcagccgttggctctcccattgtatggaaggaaaccagcccagggtcacacagctggtcagcagcaacgcagct

SEQ ID NO: 100213 - DNA, 452 bp, Homo sapiens
tgagtggggggagggcgggtctttcctgtgctgttcttatgatactaaatgagccttacaagagccaatggttttaaaaaacgggagtttccctgcacaagctttgcctctgccattcacgtaagatgtgacttgctcctccttgcattctgccatgattgtgaggcctccccagccatgtggaactataagtccaattaaacctctttcttttgtaagttgcccagactcaggtatctctttatcagcagcattaaaacagactaatacatctcctattctattttttgcaaaaacttgagaggaagtggtgttaattctttagatctttagtagaatttatcattgaaagcatcttgtcttaggcttttctttgttggaagtttttattattatctttactatttactacatctatttaaatagatcttgtaatcagtactggtcatgtt

SEQ ID NO: 100214 - DNA, 381 bp, Homo sapiens
gagctcaaggccagggcggcctggctgatactgatgcaaccacttcccaggccctgagtgtggtcccagcatctcgtctgggaaaagttaaaatgatggaggtctgaatttcccagaaaagaaaagaaacccctgggctgcaggctcctctaaccccacttggaaacacaaagatatgttctggcaccaaaagacgctataatcatccttaaacatccctgcttgggccccagcctcccccgggccagttaggactttcaatagcagggattgagggcaatcagcttcatttcttctttgccacgaactatggcttagcacttggccaagtcctttccccctcaaggtctgtttcctcatctgtgcaatggggactgggag

SEQ ID NO: 100215 - DNA, 350 bp, Homo sapiens
cttagatgtaatagctgaaattataaaactactagaagaaaatatatgaaaaagatccaagacattggcctgggcagtgatgttttggatgtcatcccaatggcggacaggcaatgaaagcaaatgtagacaaatgggattacatcaaaccaaaaagcttctgcacagtaaaggaaaaaatcaacagagtaaaagaataggctacagaatgaaagaaaacatttgtaaaccatacatctgataagaggttaatatccaaaatatataagaaacccaaacaactcaatagtaagaaaaaaaaacagattaaaaaatgggcaaaggatctgaatagacatttctcaagagaa

SEQ ID NO: 100216 - DNA, 302 bp, Homo sapiens
gcagcttccacctcaggtgtgatgtgagtactggacaagttaattcatctgatgtgttaaatgagctcaggctttaaagcatttagaacaatgcctggcacataggaaatactcagtaaatgttgatggttgttgtttcatgccctgtccctacctttccccttcattcttctactatatcacaagaatttctcttctcatgtatgtcctttaagtacccccaacctggtctgcctccagactctgatttattacctatcttgaccacaattttctaaaacaaatgaacaaacgaaagtaaa

SEQ ID NO: 100217 - DNA, 437 bp, Homo sapiens
agatgctccccatgccttgcagcagggaaatttaaattgcctctgcttagagcgtttccagacctgaaagaccagtggtttagggaagcactctacatgagggaaacctgcattagaaggagcttcttaatccctgggatctttccaagctaaactggatgtctacagtggggagaaagaaaagcagagaacaggacatgaggggggctcaaggccccgaagggttgacataggtgtcccttaaagccgaatgtagctccgcagaaagaagaccaggactgagtcaagcttctgctttcccttcaaaatcggccagattttttaaataacttgactctgaggaggaggacctgatttaagtgatggtcccatcactgttgaatcctctgtttttaaaactccccttttgatttttttgggccagagccaattttatt

SEQ ID NO: 100218 - DNA, 456 bp, Homo sapiens
gaacataaatttgttttttgtagtgttggaggatgcgaagtccaagatcgaggcatttgcatctggtgagggctttcttgctgcatctgtacatggtagagggcacaagggcaagagaaagcaaactcactgctgcaagccctttttattatagcattaattcattcatgagggcagagcactcatgacctgaacagctcccaataggcctcatattccaacactgttgcactagggattaagttgccagcacatgaatattgggggacacatccagaccgtaacactgaggcatctagtttggttatctgggcagataatgacgtctcattcaagattggaaacaggatgaaaagatttgggatcctgccaaggagtggaggaatggatgagggaaaactgattattgtttaggacttgttgagtttgaagtaactgtgagacgtctctatatag

SEQ ID NO: 100219 - DNA, 525 bp, Homo sapiens
ttggccacaaccatgcccagtttatttaaaattttttttttgtagagacagggccatgctgtgttgctcagtctggtcttgaactcctggcttcaagtgatcttcccatctcagcctcccaaagtgctgggattacaggtctgagccatcacacctggcctatcagttttgttataaccctcctactatcctagtgggtttgaagtggtacctcattgtggttttaatttgtatatccctaacagtgatgttgagcatctttgtacacgcttattggccatttgtatatctatagtgaaatgtctattcaatgcctgcccatttaaaaattgtgttatttggttgagttgtaacaatttttttttccttgggagacaaggtcttgctctatgactccagatggagtgcagtggtgccatcacagctcaatatagccttgacctcccgggttcaagtgatcctcccacctcagcctccccagtagctaggagtatagacatatgctgccacacccggctaattttt

SEQ ID NO: 100220 - DNA, 803 bp, Homo sapiens
accctgttaaaacaacaaaaatccccaccagtatggctttgagagaaggccccggctttgaatctctgctctgtggcctggggcagttactcagactcatctgtagaaagtgtggggcccttaggactgctgggggatcaaatggtggggggcactagtctgcatggagaggggagcagcactggcagccccccagtcagcgctggcacagccttgccccggccatccacccctgctggagcttcggagtggagctccgtcctcctggctccatccccgccggctgccctgtgatggggtgccctatctggggtgtgcccagagcttcctggcagcacagcagggcagaggttgggacgctcggagctggtcagagtcttcgggtaccccttggacatccctggtcccaaccatgacgggctgcttggacaaggccacctcacatttgcaggtgctccaagggcagcccccagtgggctgggcccctgccagagtgggggctgctgtggccagggctcaggtggcccagaccctggctctgctgctgctcctggtgtgacctcagacaagccccgagcccctcgccgcctcttcacggggaaagggaaccggcctgattctgtagggtaggggtgagagagggtctcggtctcggctcttttctggaagaacctttcggaggtcgtttcagaggtctccactggcgccgacactttcttcctgatgtggccctgccttgaggggccagtgaccttccccagggtgtgtggggccccatttcctctgctggggtgcagaggctg

SEQ ID NO: 100221 - DNA, 364 bp, Homo sapiens
aaccatcaagtttaaagactgctttgtggctaggcgaagtggctcacgcctataaccccagcactttaggaggccaaggcagaaggatcccttgaggccaggagtttgagactcacctgggcaacatggtgagacccccatctctacaaaaaataaaaacaaaaaattagccaggcatggtggcatgcctccatagtcccagatacttgggagggtgagacaggaggattgcttgagcccacagatataagcccagacgcctaggcgagagtgagactgtgtctcaaaaaaagaaacaaagaaagagaaagagaggaagggaagaaaagaggaaggcaggaagggagggagggaagccaaagaa

SEQ ID NO: 100222 - DNA, 145 bp, Homo sapiens
gtacgaatgaatcagttgcttatttgctctcacttctctgagctttggatgctcaggaagaaaggatttgagccaatggatgaccatggggtccgtggaacgcaataagccctgccttcttgtggaagagaggacggggctgtgg

SEQ ID NO: 100223 - DNA, 472 bp, Homo sapiens
gcaatctatcttagaatcttgtcaaaggtaaatacaaggttcagggtttacggagccaccttctagccctttaagccaccagaattgctggtgtcttatggactcctgagaagtttgtggtggtgattcttagagctcagctcccaactgctggactgccggtcactgggcagaaacagaactcagttctcatcacctggatgccatttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcggtggct

SEQ ID NO: 100224 - DNA, 301 bp, Homo sapiens
ttctggctgtgtctatgagggtgttgctggatgaaattagtatttgaatccatagactgaataaagcaaaaacctccctcaatgtgggtgagcctcatccaatccactgaaggcctgaatagaataaaaggctgggtaagaaagaattctctctacctgtcttctcctgcctttgggtagcccagcactcacatcatgggctctcctggttcttgggtctccagactaggactggaatgacaccattgtctctcctgggtatccagcttgtcaagtgtggatcttgagttggggcttggcc

SEQ ID NO: 100225 - DNA, 259 bp, Homo sapiens
accttttttttttttttggcccaaatcaaatatagtcctaaaaaattttcatactctcgaagtctaaaaacaaagtagataacttaggtctcgaattcaggtttgagttttacttaaaagggtcatattcaccacactgtcttgcaacactaaactagctgggaaaatccgggggcatggaagaaaaaataattaggggcatggtagaaaaaataactagattacctagagttctcgtgtctttcagttcatgtcattt

SEQ ID NO: 100226 - DNA, 732 bp, Homo sapiens
ctcatgtgaatcaattatgtaaagaaatttcagagcttccaagagcacaaacttaaaataagtaaagaagacagtaaaattcttaaaaaggctcagaaagatggatttttgcatgagacgcttctggacagaggaccaaattgaaagccaacagatactgcaaatgactgggatttttgtttctgccttatctttttgtgttttttttctgaataaaatattcagaggaaatgcttttacagagttcttgagttgttgtgaacttattgtttagctagtagctagtttaaccaggattaaacaagtttaatcaggattcttcatggatgtactttttagctaactacagtttttcacatggaaatgaaacttacagtaaacacttaacgtaccacagaatttttttctggatttctggtcctgaagcatgaagtgtactagaaaccaattcttcctgcgctacttgtggaatctttcttactggatcataatcttactttactttatacaatagatgcttaatcagtgcctttaataggaagttagaaactcccaatccaatcaacaaggctttgattctacctcctaagtactacccagatcacagacaatccaaatatcagaactagggggctgggcagagaggacaaatcatctattagggagtgggacagaaagtggaaacattacaaaggagcaagtaggctcagaacagaggggagagtaatactg

SEQ ID NO: 100227 - DNA, 2486 bp, Homo sapiens
acggaggcgggttctggacagacgtacgctgtcagggagtgtttactttgcctccacttctgttcctccccgccctggtgctgctccgggtcacatactcgtcctgagccggcttcagcctctctgcgcagaagtgtcccggagccatggccgagtaatcttatgcgaagtctaccaagcttgtgctcaagggaaccaagacgaagagtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacaatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtcaaacaatgtgaaatcaattatgtaaagaaatttcagagcttccaagagcacaaacttaaaataagtaaagaagacagtaaaattcttaaaaaggctcagaaagatggatttttgcatgagacgcttctggacaggtagctatttatttacttattttcactgttttcagtagccaatagaaatggcatgtagaaaacctatattctcttaaattactgtagttttcacatttttgtcttcatttctaatttatgagtgtggcaatattacctagagaggacatcatgagtttgggaaaagactgtcaacaaagaatatctaaaaattataaccgattctaagtatatactttaagaaattcaggtttgactgtatctacttcataaatttatcattatctttttataactattagaaccagagttagaaagaagcagtttggctaatataaaaattatgtggattctgttagagtagttcagcttccttaaaataagcatatatcaactaacaaactaaatataaaagctaaacaagtgaaactgaagcagatttattgtaagatttggaagagtgcaggatgtttatcatagcacattattaatatttattattcttcctatgtagataagtaatgtcctagatttataccatagaaaaacaggtagagacgtttagctgtgagtgtacaagtataaatcaattaagtgccagattttgatcatcaccagttgctcattcaagtcctatgttgcaaagttactcttacccttttttacattacttgataaaggcaatgtttaattacatatttcctgttaactagctggtagagtacatacgtaaagtcagtaaataatgttacaaattttttccagctgagtaagtgaatatgtatctagttgtaagaaatcaagaagaggataaaaaatataatcaggatgtggactctaaaacggaataaactctatgtcctgtaacttttctcacttgtaataatacagcattctcaccctgttaaatggaaatttagagcacccttaaattccggaataaaattgctatttggatagaaaaaacccttaggcaacatttattgaatattaggaaataacttttatgggattagaatccattttttatagaaaccaaatttaaaagtatacatattttaatataagtgttgtgataatacagtaaccaaaattgaacacacagttttatagctttttatatttagtagcagttgaatatatatggcatgttttacatagattaattttactatttttctttgtttaaacaagaggaccaaattgaaagccaacagatactgcaaatgactgggatttttgtttctgccttatctttttgtgttttttttctgaataaaatattcagaggaaatgcttttacagagttcttgagttgttgtgaacttattgtttagctagtagctagtttaaccaggattaaacaagtttaatcaggattcttcatggatgtactttttagctaactacagtttttcacatggaaatgaaacttacagtaaacacttaacgtaccacagaatttttttctggatttctggtcctgaagcatgaagtgtactagaaaccaattcttcctgcgctacttgtggaatctttcttactggatcataatcttactttactttatacaatagatgcttaatcagtgcctttaataggaagttagaaactcccaatccaatcaacaaggctttgattctacctcctaagtactacccagatcacagacaatccaaatatcagaactagggggctgggcagagaggacaaatcatctattagggagtgggacagaaagtggaaacattacaaaggagcaagtaggctcagaacagaggggagagtaatactg

SEQ ID NO: 100228 - DNA, 806 bp, Homo sapiens
acggaggcgggttctggacagacgtacgctgtcagggagtgtttactttgcctccacttctgttcctccccgccctggtgctgctccgggtcacatactcgtcctgagccggcttcagcctctctgcgcagaagtgtcccggagccatggccgagtaatcttatgcgaagtctaccaagcttgtgctcaagggaaccaagacgaagagatttgcctgaggttgactgtacatgcaaatattgagcatttcctcctggtctccgtgataaacaaaggttttgatattgttaggcgagatggaaagaaagtatcaaggagtgagctgaagccactgcccttgagaaccctctcgaggagtctggcctcatgaagatgccagaataaacggcagtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacaatggtctttttaccctgggagctccacacaaagaagttgatgagggccctagtcctccagagcagtttatggctgtcaaattatctgattccagaatcaccctgaaatctggctatggaaaatatcttggtataaattcagatgaacttgttgttgggcattcagatgcaattggaccaagagaacaatgggaaccagtctttcaaaaccgggaaaatggcttgtcgaactcaaatagctgtttattagaatacg

SEQ ID NO: 100229 - DNA, 2338 bp, Homo sapiens
cccgtggccccgtacccacgagtttcagtcctctgaggcatctctgcaggcctctgcctgtaagaagaaaaagagcaaagagaagaagagaaaaagagaagaagatgaagaaacccagtttgatatgttggaatctggtgaacagtaacaaactttgatgaaatttcaggaaccatagccattgaaatggatgagggaacctatatacatgcactcgacaatggtctttttaccctgggagctccacacaaagaaggggaaaatggctttgttggcctcaaatggctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtcaaacaatgtgaaatcaattatgtaaagaaatttcagagcttccaagagcacaaacttaaaataagtaaagaagacagtaaaattcttaaaaaggctcagaaagatggatttttgcatgagacgcttctggacaggtagctatttatttacttattttcactgttttcagtagccaatagaaatggcatgtagaaaacctatattctcttaaattactgtagttttcacatttttgtcttcatttctaatttatgagtgtggcaatattacctagagaggacatcatgagtttgggaaaagactgtcaacaaagaatatctaaaaattataaccgattctaagtatatactttaagaaattcaggtttgactgtatctacttcataaatttatcattatctttttataactattagaaccagagttagaaagaagcagtttggctaatataaaaattatgtggattctgttagagtagttcagcttccttaaaataagcatatatcaactaacaaactaaatataaaagctaaacaagtgaaactgaagcagatttattgtaagatttggaagagtgcaggatgtttatcatagcacattattaatatttattattcttcctatgtagataagtaatgtcctagatttataccatagaaaaacaggtagagacgtttagctgtgagtgtacaagtataaatcaattaagtgccagattttgatcatcaccagttgctcattcaagtcctatgttgcaaagttactcttacccttttttacattacttgataaaggcaatgtttaattacatatttcctgttaactagctggtagagtacatacgtaaagtcagtaaataatgttacaaattttttccagctgagtaagtgaatatgtatctagttgtaagaaatcaagaagaggataaaaaatataatcaggatgtggactctaaaacggaataaactctatgtcctgtaacttttctcacttgtaataatacagcattctcaccctgttaaatggaaatttagagcacccttaaattccggaataaaattgctatttggatagaaaaaacccttaggcaacatttattgaatattaggaaataacttttatgggattagaatccattttttatagaaaccaaatttaaaagtatacatattttaatataagtgttgtgataatacagtaaccaaaattgaacacacagttttatagctttttatatttagtagcagttgaatatatatggcatgttttacatagattaattttactatttttctttgtttaaacaagaggaccaaattgaaagccaacagatactgcaaatgactgggatttttgtttctgccttatctttttgtgttttttttctgaataaaatattcagaggaaatgcttttacagagttcttgagttgttgtgaacttattgtttagctagtagctagtttaaccaggattaaacaagtttaatcaggattcttcatggatgtactttttagctaactacagtttttcacatggaaatgaaacttacagtaaacacttaacgtaccacagaatttttttctggatttctggtcctgaagcatgaagtgtactagaaaccaattcttcctgcgctacttgtggaatctttcttactggatcataatcttactttactttatacaatagatgcttaatcagtgcctttaataggaagttagaaactcccaatccaatcaacaaggctttgattctacctcctaagtactacccagatcacagacaatccaaatatcagaactagggggctgggcagagaggacaaatcatctattagggagtgggacagaaagtggaaacattacaaaggagcaagtaggctcagaacagaggggagagtaatactg

SEQ ID NO: 100230 - DNA, 347 bp, Homo sapiens
tcgagcctttgactattctttccatataggaagataggactagagttaagttgggaggcagatggggaaactgcctgattgttctgcgtcagaaagcagaattcattcctttgcccctgagaaggcaggaaagagaggtaaaatgggaaatggagagaagggagagaggagatgagagcttagccacatggcagggaaattgagcagctggactttttttgcctgtcttctcaaacctctccatagcactgcatgtgagtagttttctgtgaaaattagggaaacttgaactccagggctgaatagatgtaccctgaagaaaaaacatgagattatccatccaccac

SEQ ID NO: 100231 - DNA, 730 bp, Homo sapiens
aattcatgaaattaaacagatattattgcctttgggaaacatgtttttattgtcatttaaatcacatattaagaaaataatattgctataatttttagtccctcctttgagttctttctagctaagcactttcaatgtgtaaaatatctatccttcttacagagagacaagtatacaaatagttaaaagttaggattaacaatgccatattaatggtggaaaaagccctacccttcttttaacagggtattttatacctgttgttttgatattcatttattaatgtattaaatatgccatataattttctggatcttagtttacttttctgtaaaattttacttctacaattatttgagattttatatctatttttggaatatataactgttcacttacagtcctctaacatctattacatttatactttttgacaggcattgttcaaagaactttagttatattaaacatgactaaaacctgatgacaaactatttctgtctctattatgacaggcattgttgaaataactttagatgtatcatagtaaacatgacaaaaacctgatgacaaactatttctctccatctatggcaacaaaagtggcccatagagagtttgctccagatcagaaagctagtggttccagtgctagagagggaaagatcatacacttaattgacacacttatttatggcatactatgtgccagtaactactcaaactgctg

SEQ ID NO: 100232 - DNA, 404 bp, Homo sapiens
ggacaacagcagtgcaggactgtgatccctaaaagaagggaaacaaacaaagtgagctttacaggcacccacccaccctggctttttgcctggggcacattctaaattgtagatctgggacagggaatcttgagcaaagaacaagatgaagagatagagatcagaatttatggaagctgaggcagcaagaagttgtagggcaaagttcagcaggaaggacactttgtcaaaattaatgctatccatagaagtctctgactttttgctgaattctagaatgaacatacatggagtaaaactgtaaagccagacaaagagcaaccagattgatgtgaactgacagacatcagaggtcacagagggctgggaagcatttgaggttttactagctagaggggaaagtc

SEQ ID NO: 100233 - DNA, 243 bp, Homo sapiens
aacagagactgtgtatgttgcccacaaaggctaaagtattgactggccttctaagaaaacgtttctcttcctctgctctatatattaacatgcacatatgactatgcagagcttgttttgttccactggggctcttataataaaataccatagactgggcgacacagcgagcccctgcctcaaaaaaaacaagacaaaaaattcatttttactgttgtatatttgacagttgttctttgggtc

SEQ ID NO: 100234 - DNA, 412 bp, Homo sapiens
gaaaaaatcaggcacgtcatgtcatttaattatttccaaggagtggacgttggcatgtagttttgattgatacttggaaaagaaccaacaaaaccctacacgaaacaaacaaacaaaaaattatactatatggcaacgcactgagagaagccaggtggaaactggttaggtcacaggatcagagccgcttcaagaggggcacggtctcactctgtcacccaggctggagtgcagtggcgcgatctcggctcgctgcaacctcacctcctgtgttcaagctgttctcctgcctcagcctcacaagtagctgggattacgggcatgctccaccacgcctgactaaattttgtattttttggtagagacgggatttcactgtgttggccaggctggtcttgaacgcatgacctca

SEQ ID NO: 100235 - DNA, 216 bp, Homo sapiens
tagagaaccagaagctgggacgatggaacactccctttggaattagggtcagctctcaataaacacgaaaaacacaaaaagcaaaagagggcttaatttaaaagtcagaatcatagcaacaagaaagtaaggtcttcctctaagacctaagcattagattctaggactgtagactcttaaagaggaagtcaaggaagagggagaaatggagggaag

SEQ ID NO: 100236 - DNA, 439 bp, Homo sapiens
aaaaacagtgtgtgaaaataaactcagactagctgagaatgatgtaataaagactgtcaagtaaaaataaaagtgtaaattataatacaggtcattaatcagtcattatttctttttttaatcctccctttctagaaatatgagggaaaatattcacagaagcaactaatctagagtcacgtaagtagtttcaagttctaccttaaccagactttggctatgtcttttaattatgggaatttgagttaatctttaaacagagattctatggcattctcccctgcatcccactctactgcacactcactggcctccttgctgttccttgagcccaccaagcactcaaaggccttaggacctttgtactggctgctctctgcttggacttcccatagctctctgcctcaccttcttcaagttggctcaactataatctcat

SEQ ID NO: 100237 - DNA, 297 bp, Homo sapiens
gcctttgtcagctcccctaagtgtgtgatcttgcaaactgaggtcacgccagatgccgaaatctccatcccccccaggagccctcacgctgcatgtcacagccacgcccacttctccgcctggaaacctctctacatctgtgctccctttagtttcgtcattttgagcacattctatggacaggatcttgctatttgcgacctcggggactggcttttatcaccatcattccctgcagatccatgcagggtgctcagccttttaatcccgagcagtatctgccctttgcctttcaac

SEQ ID NO: 100238 - DNA, 533 bp, Homo sapiens
ctccaaccaatggagtgtgaggagatgggatgtgtgctcaggctggtccaggataagctcccatgcccttgcttcatgctctttccccttctactgtcttgcggcaatatggctggactatagctcagctctcctaccttccctttcacccaccacagtgctatgccatgttgctatctctcactttagcagaacaattcacaccagaaacctaccccttaagaatgtgtcttaaatgtccttcaatgctgggcacagtggctcatgcctgtaatctcagcactttgggaggccgaggcaggcggatcacgaggtcaggagatcgagaccatcctggctaacatggtgaaaccccgtctctactaaagatacaaaaaaaaaaaaaaaatagctgggcgtggtggcggttgtctgtagtcccagctactcgggaggctgaggcaggagaatggcgtgaacccgggaggcagagcttgcagtgagcagagatcaggccactgcactccagcctaggcaacagagcgagattccgt

SEQ ID NO: 100239 - DNA, 306 bp, Homo sapiens
cctgaagtaatacactctgtattcatttgcaatcattaaaaatttagagtcagtttaccatcctaccaagtagctaagtaacaacacctcgctttcccagaggtcagtcttcttgcaacttcagcctcttaaaacaaatccaagagttgaaaaaggatgctgagtgtcgaatattactgtacaaatctcatgcactaaaatctcttcaaaaatgagccctgggatctctttcacatcctatttgttttcttttacatataatccagataagctttcttatttggcttttgaatgtacgttgaatat

SEQ ID NO: 100240 - DNA, 214 bp, Homo sapiens
gtgacagcccatcccatgggatgaagcattcatagcagccgatagtgaaatcctggccatcctttctgagtctcaggcccaggcagcacgccagctcctggcacacgtgagctcattactgtgggcttaggtgttgcagaggaatggagtttgcagggctgcagctctggtaaaggccacccagcccgagtggcaggtctgtgtgcagagccta

SEQ ID NO: 100241 - DNA, 111 bp, Homo sapiens
tgtgtgcagggaatagcaggcagttccatttctctccaggaagaggtatataaagaggtggaaggagagtctatattcattccataaatgtgagatgcacagaacaaccag

SEQ ID NO: 100242 - DNA, 768 bp, Homo sapiens
attaggaccaggcagtcagtcatctgttctgggagacaaaccagtccaggacaagtagcgtttggacaatatgccaaatcctgtcacatcacattgttgctctaaaatgggtggatggattgggttgatggcatacgctaagctccatgagggcagggattgtggctggactaagtctagtggcaattaaatagagctcaaattaaatagagcttttgctttgaggtctgaatccatctccatgatttgtcactagactagtgacaaacagtggctgggatagcatatgttgtttagacagcttttgcttgttctaaaagtttgaatgtgaattggggtttgcaactcaaaatttgtgtttaatatttgcaccttatgtttaatgaacataaagtttgtgtaggccatgtgaaaatcagagactgtatatttggctgaattgctctgtaatacatatattttaatttgggagctctctgtattaccgaggacccaggatagagactcttactgtttctgacctgatcatttaagggcaggtttttgcccaggttatgagactgatgcatcatgccttgaccagttaagattagtgacaatttaaattttctgcttttgatttaagtaaaaattcaaattaaatagagcttttgctttgagggctgaatccatctccataatttctttctacatgcacatgtgtagacaatttccctttatctgttcttacagataaacttctccataattgcacacttatctggggat

SEQ ID NO: 100243 - DNA, 373 bp, Homo sapiens
ccttgtaagcactgtacaggcaccaagggtgaatacccacccctccaccgaggagaccacgcctcttgaaatgacccagtgtttcccctgtcctgcaaaagtgtgagtagtacatcatcacaatcacagaccccgtcaccctccccttctctgcttcttttcctgttgccctcttaaatcacatataatctggctgccatgacatgattaaagacgctgaaccctcattccaagggcacaagtccttctggagacagactgactggcatatagtgtttgactattgaccacctccatgctcttctctcctgctgttctcacctccggctgtcctagctctcctctgcctctccaagctctcctggaagggttc

SEQ ID NO: 100244 - DNA, 931 bp, Homo sapiens
agcggcttccttctctccccccaagcctccatatttatttccttcctactaaaattttcttccacattccctctcatccagtcctcaatgaatcctgaggacagctatcagtggtcactctcttgggcttgaaatggaacagatcttcttgttccatctctttctgatagcgccagttcctgctgaggacagaacattgtcttcttttctccctgcctcaggcagatggcagggagtgttgtgtgttcccacaaaggagcgtgctgtccccgctcccgagtctctcagcgagccctgtcatggaaggcatccaggagaatgtggaactccgcacccgctttctcagaacagaggagcatccatgaccctcagaatcacagcattgagaggtatgtatcaactccaggtctctgcatttgtccgcgttcttcactgtcatgtggctcctcccgatgtgatagcaaagatgcccgtggacaaaccaggcttgggtccatcatgttggcaatctggaggaagccgagcactttttctccaactgactcagtcccaggactggctctcatttgcccagcttgtgcagaatctcattgtcctaatgttaaatatatatcatcagtgctcaatgttacagcttcaaacatagaagatacaagaagtaaatgctgagatttcgctatttgttaacctatcatgtgatgaacctatacaaattgtgtaaagcaaatgttttcaggcattggatgtccaagcagcacaggactatcaacctgaaggacaagagaatccccaagatgagcctcatatttatcctggctttccgcttcggagcactctctcaacttcaacacagagaagtgaaacccaagtgaaagagtattgctaaaccaaggaggcagacctcatgtttgttcaagagtacccaagagat

SEQ ID NO: 100245 - DNA, 82 bp, Homo sapiens
ttcatggtgacaggatgcaccaccctgggaagtaatatatctaaagctctctaccaatgagcttctacatgtaaacttactt

SEQ ID NO: 100246 - DNA, 373 bp, Homo sapiens
ttcatggtgattggttgaagggagaacatgtgacttgagctgggccaatcacagccagtaggagtctgtcctgggacttttttggtttggtttctttttggagagggagtctagctctgtcacccaggctggagtgcagtgacacaatctcggctcactgcctcccgggttcaagagattctcgtgctttagcctcccgagtagctaggattacaggcgagcgctaccgtgcccggctaatttttgtatttttagtagagacggggttttgtcatgttgctcaggctggtctcgaactcttgacctcaagtgatccacctatgtcggcctcccaaagtgttgggattacatgcttgagccaccgcgcccggcc

SEQ ID NO: 100247 - DNA, 501 bp, Homo sapiens
tcataattttctacctgtactgtagtttactgaacatttcagtaaagtgttctctttcctgctattttataagcccctcagtagacattcactaaattattgttatttctagatttggatctctacttggatatctaataggcacctcagatctactatgtctaaaatctagctcttgatttcctcctacagccttccgcatttcagtaaatgacaatgccattcttccagctgcttaggcctaaacctctctttctttcacacccttcatccaatccacaagcacatcctgtcaactcaaccttcaaaatatattcaagtccagccatttctcaccacctctaccatcatctctctcctgtgttcccacaaaagcctgccaactgatcttcttgcttccacccttgcctctactagtcattcccaacacagcagccagagtattgcttttgaaacatacgttgccactgggcacagtggcccatgcctgtagtaccagct

SEQ ID NO: 100248 - DNA, 239 bp, Homo sapiens
aggtgaatgactgttatacctatttaggaaaacagacgaaaccaataaaaccaaactatttctatacagtgattattagcagagatgccattggcattttagatgcattttgggactgttccacacatttaggacattacattcctttccctttgcactaaatgccagtagcacttccctagacactgacaaacaaaaagtgcccctgtagatttctgaaaaggccagggtgtggattg

SEQ ID NO: 100249 - DNA, 409 bp, Homo sapiens
tggctttaaaagataaaccaaaaaagattaattgcttaagcaaaatggtgtgtttccaattagtgtcatcctttctgttaattggagacaggttaataaaacatgggtcagtaacactacgacttttttcccccaacatccccgaaataaaatttattgttccactaggaaaatgtaagcggtgcattatcttttcctcaagtgcttaagcattatgtcctgtgatggatgggtacgacaggcagtggcggggtaggcaaaggaagtgggcaggcttgtttccagctgatgacctttgaaaagttcacgaccagcaaacattcatcctgctgccaaaatagcggatgatttcaaagtcacggtgttaagcgggttgctaaggaagtgttacggtggaggctattgtgta

SEQ ID NO: 100250 - DNA, 766 bp, Homo sapiens
tgtttgatctatatttatttgactttgacaatctgatattatttagcattatttccagtcccccaaataatgtcaaaattttgttatgttagataggaatatcttgttattcaacttgaaggtaaactgcttgatcaatgcatgtaattccttgacagatcatcagcacctctaagacaacatgtagatattgctcattattaactcatttcatcttttcatgataaattacataaatctaattttcgtttttaaaatgcaaaccattatgcctcgtattatggcattcttgcattactataaaggaatacctaagcactacgtaatttatacagaaaagaaaggttgacttggctcacagttctgcaggctgtacaggaagctttgcattggcagttgcttggcttcaagaagggtcctcagggaggttttacacatggcagaaggtgaagcaaaagaaggtatgtcacatggccagagcaggagcaagcagggagaggtgccacacacttttaaacagccagatgtcatgagagctcactcactcttgcaaggacagtgccaagaggatggtgctaaacatgagaaatcagccctcatgaccccatcaccttccaccagaccccacctccaacactgggaattacaattcaacatgagacttaaagggtacaacatccaaactatttcattccatccctgggcccttcaaatctcatgttcttctcacattgcaagatacaatcatcccttctcaatagtcccc

SEQ ID NO: 100251 - DNA, 747 bp, Homo sapiens
agccgagaactggggcggcgcggcgcggcgcggtgcatttccaggcgctgctctccgtcgcagagaaccctgagctcggcgcgccgagagtcccagcagggcaagggggcgcggcgtcctggtcctcgagcttgggagacagatgcgcatgggcgtgggggcatgcggacctaagctcgggtgaagctctcgggaagggcaagactgcggcgacgagatgcgagcagaggagccctgcgcccccggggcccccagcgccctgggagcccagcgcacgccgggccccgagctgcgcctgtccagccagctgctgcccgagctctgtaccttcgtggtgcgcgtgctgttctacctggggcctgtctacctagctggctacctggggctcagcataacctggttgctgctcggcgccctgctgtggatgtggtggcgcaggaaccgccgcgggaagcttgggcgcctggccgccgcctcttcgaattccttgacaatgaacgcgagttcatcagccgcgagctgcggggccagcacctgccagcctggatccacttcccggacgtggagcgggtcgagtgggccaacaagatcatctctcagacctgccctacctaagcatgatcatgggaaagcagttccgggagaaacttgaccccagatccgagagaagagcatccacctgaggacctttacctttacaagctctacttggacagaggggggtgtgtctcgggaagggcagcctga

SEQ ID NO: 100252 - DNA, 211 bp, Homo sapiens
tggcatgttgagttgagccatgtgagttgtgagttacaggatccctctttctaaccttctttcagggtcctctagacgttaccactcaagcagaagcaaggaaggggaacccaagggagagaagagggtggtgcatttattctcttcctgctaaagctactgccctgactaattggatttagccctgccttatctttggcctaaccaaaga

SEQ ID NO: 100253 - DNA, 1012 bp, Homo sapiens
ggcgcgctgaggctgcttctggtcagggaaaccattctcctacaccgaccccagcaggcagctgcgcccccagagctttaccctgtctctgcactgaccttggggaaggaatttagggaggggtaaaacaaggctagagctggtaccattactgccccgggagagtcccctctgccgccaccagagacagccaccaaagcgccccacgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggcacagtggcatgcacgggaggtcgccattggtcaatacctacactctgatgttgggcctcatggtcgcgcattggtactcgagggctggccattccacacacagcgccagtgccccactggggaggagatgatgtcatgttgccaagttggatcaaacacaagtatggcgtctggtaggtgaaccagggtcgctacacaagatggatcgagccggagggaacctgggttgacatgatgcgctgcccgcacctggctcgccaccaggacgagacccagtggacaggatggagggatggggaaggacttcgctcagagtcctcccgatactctgcacacccacctacacatgtgcctgatacgggggctcggcaaggtgcgcttcctccgcatggaacatactcgcagctccggcaaattcttgccattggtcaccttcttaacattactgggggaccatcaagggcaatgg

SEQ ID NO: 100254 - DNA, 2106 bp, Homo sapiens
ggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttacccatgcctccagctacaaaacaattcaattgctttttttttttggtccaaaataaaacctcagctagctctg

SEQ ID NO: 100255 - DNA, 1881 bp, Homo sapiens
  misc_feature (577)..(577): n is a, c, g, or t
aaaaatacaaaaattagccggcatggtggcgcacgcctgtagtctcagctagtcaggaggctaaggcaggagaatcacttgaacctcggaggcggaggttgcagtgagtcgcaaacgcaccactgcactccagcctgggtgaaagagcgagactctgtctcaaaacaaaacaaaacaaaaaacctaacaaaaacaatagctaccatttactagacactcactacataccaggcactgtgccaaacagctccttcttatcagctcagggtgctgggggtgccagggagggaaggtcagtgaaactgtggcaggtgtcggttaagcaaaagaaggctggcatctgtgcagctgggggcaggccttccctcctccaacccccttggccaggagcatcacagggcaggcctgagcttccacaaggtgacccagccagtcaccatgaggcaggccccaggcgccaggccactctgcagaggagccacgcaggaggtgacctttcctatcttgactgaaacgggcacctggcgtggaggccaagtctggagccagccccctaggagagctccaggaggcaganatgcctgcggggtcaaagcctgccagctgactgctgtgccctcctcaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaatccccctttcgccagctggcgtaatagcaaaaaggcccgcaccgatcgcccttcccaacagttgcgcaacactgagggg

SEQ ID NO: 100256 - DNA, 597 bp, Homo sapiens
  misc_feature (547)..(547): n is a, c, g, or t
  misc_feature (561)..(561): n is a, c, g, or t
  misc_feature (574)..(574): n is a, c, g, or t
atatgcgtctccaagccccagccccaccctggcagagatattgatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctggcaganatatatgatcgggntgccaagaacttncataccttgatgttgacctggat

SEQ ID NO: 100257 - DNA, 2375 bp, Homo sapiens
ggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaatccccctttcgccagctggcgtaatagcaaaaaggcccgcaccgatcgcccttcccaacagttgcgcaacactgagggg

SEQ ID NO: 100258 - DNA, 1983 bp, Homo sapiens
  misc_feature (1933)..(1933): n is a, c, g, or t
ggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcaaatgatcctnccacctggcctctcaagatatctcatgcagcaggtaacatcgactgggat

SEQ ID NO: 100259 - DNA, 1376 bp, Homo sapiens
ggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacagcttctccagcgggatccagccactcctctgttccctgattggcctggagaatcccacctgaccccccaccccacccctctgtctctggctggggttcctttctggcccaaagtaggtccaagcccttgtagttatttcgccacctgctgtacattgtgggaactgcaacccctacgtgcccgtttgggtggagagagattaaacatttgcccaccaagcc

SEQ ID NO: 100260 - DNA, 942 bp, Homo sapiens
ccaagcaacgggggggcttcgccgttggttctttcctgggcggccctttaaaactgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaatccccctttcgccagctggcgtaatagcaaaaaggcccgcaccgatcgcccttcccaacagttgcgcaacactgagggg

SEQ ID NO: 100261 - DNA, 692 bp, Homo sapiens
tctagtgatccctgtcaatactacatcgcgtgccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaatccccctttcgccagctggcgtaatagcaaaaaggcccgcaccgatcgcccttcccaacagttgcgcaacactgagggg

SEQ ID NO: 100262 - DNA, 629 bp, Homo sapiens
  misc_feature (20)..(20): n is a, c, g, or t
tagggctcggcgtggtagcngtacctacattcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaatccccctttcgccagctggcgtaatagcaaaaaggcccgcaccgatcgcccttcccaacagttgcgcaacactgagggg

SEQ ID NO: 100263 - DNA, 1031 bp, Homo sapiens
ggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggcacagtggcatgcacgggaggtcgccattggtcaatacctacactctgatgttgggcctcatggtcgcgcattggtactcgagggctggccattccacacacagcgccagtgccccactggggaggagatgatgtcatgttgccaagttggatcaaacacaagtatggcgtctggtaggtgaaccagggtcgctacacaagatggatcgagccggagggaacctgggttgacatgatgcgctgcccgcacctggctcgccaccaggacgagacccagtggacaggatggagggatggggaaggacttcgctcagagtcctcccgatactctgcacacccacctacacatgtgcctgatacgggggctcggcaaggtgcgcttcctccgcatggaacatactcgcagctccggcaaattcttgccattggtcaccttcttaacattactgggggaccatcaagggcaatgg

SEQ ID NO: 100264 - DNA, 403 bp, Homo sapiens
ctcctatgatgtctatgccaagggcgagcttgtaaaggagctgggcgtctgtggtgtcagatgaggcagcacccaggaattggctacccagatgtcaactgtctttctgaccctgcagaggggcttctgatgtcatagctgagaccaagcgcctggcagtccgtgtcccacaatgtcagggctggtgcaagcccatgctcagctgaactcatgatgtccaagtggagctgatgtgcaacgttgctaactcggtttcccctgctctccccagaggacctggtgcagatgcctccgacgccccccagcagccatggcagtgacagcgacggctcccagagtccccgctctctgcccccctccagccctgtcaggcccatggcgcgctcctccacggccatctcca

SEQ ID NO: 100265 - DNA, 362 bp, Homo sapiens
aggtcacacacacagccaatcaagaggagtgtgaatctggtgcccaagctcattctgtaagctgctgaatgaagaggatgtcctcacctcttctggccccagacaactcctcctcacctcacaaccaccctctttcctgcctgccccctggtctaccctaacagctctcttcagttcagcctagggtagctcccagggggcaggcagggggctgagacctctgccctagagtcccctgagcctttccccttcccctagatgcagagcatggagcatgggcgctgggacacaaactgtgctccatcatggtgaagcaggagcagagcccggagctgcccgtggaccctctggctgccccctcg

SEQ ID NO: 100266 - DNA, 672 bp, Homo sapiens
gcatctggtcaggaattcaaatcctttcgccctgcctcatggtgagcaggagactattgcagagccaggactagaacttgacattcctgacctccaggggatgacccaggctgcctccaaggagcgctgtgtgaggggaagtgcccagatggtccagaatccccaggaaacatggagctaggccctgagccctgggatgggtgtggagtctcccaagccaagattgtagggaggggtctgagggagatgctgtttggggcaccctggacaagtaagctttgagggtgcagtctcagggatgggatccaggaagccctcccgaacaatgcactaagagcctaacacctgagctctcagcatggccctggcacctgacacatgttactgaatttcacccagatccactccctttccagatgaggaaactgaggcatagagcattgtgtgccttgcccaggtcatatagatagcacatggcagagcttgaatttgaacccagggctgcctggctcctaactaccacatcatacttcctacagaaattacaggggacatcagggccactgctcctgacagaggaggagaagcggaccctgattgctgagggctaccccatccccacaaaactccccctcaccaaagccgaggagaaggccttgaagagagtccgga

SEQ ID NO: 100267 - DNA, 2412 bp, Homo sapiens
ggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaatccccctttcgccagctggcgtaatagcaaaaaggcccgcaccgatcgcccttcccaacagttgcgcaacactgagggg

SEQ ID NO: 100268 - DNA, 2393 bp, Homo sapiens
ggcgcgctgaggctgcttctggtcagggaaaccattctcctacaccgaccccagcaggcagctgcgcccccagagctttaccctgtctctgcactgaccttggggaaggaatttagggaggggtaaaacaaggctagagctggtaccattactgccccgggagagtcccctctgccgccaccagagacagccaccaaagcgccccacgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaatccccctttcgccagctggcgtaatagcaaaaaggcccgcaccgatcgcccttcccaacagttgcgcaacactgagggg

SEQ ID NO: 100269 - DNA, 2136 bp, Homo sapiens
ggacagcacagaggaggcaacagaggtagggacaccattagtccatgctggggggcaggcctcaggcacaggagggattccaggttctgcggggctggaacctacctcttccccacccctccctgtgctgtccagctgtccacctcctctgggacagcacagaggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaatccccctttcgccagctggcgtaatagcaaaaaggcccgcaccgatcgcccttcccaacagttgcgcaacactgagggg

SEQ ID NO: 100270 - DNA, 1670 bp, Homo sapiens
gtaaatacctattcacccactgtatgccagccactgtgcttatatgcaggggatgcaaaggtgcatgagacctgccctctacctttaagaacagtataatggagaaggggagacaaaccttgtgacagattccttatgtactgtgataatacacagtggcagcagctaaaatgtctaggtttgcttagctttgtattcagtaataataagttgatctaagagttcagcataaactgaatgaaatgccatttaatggtagaggaaccaagcattaaggcagtactacacttaattttttaagcaaatatgtaaagtatattttcaaacttttctaatgttatggccccaaatttcttagttttggcctttttactacctatactatttttactgttttgttttgtctccatgtggtagtacttctgtgaactctaaagggaaaaaaaattctgcaagcagcattagtatataactactactgtaagtaaaactgcctattgacactttaggagttcctgcttcagaagcttagttaagaaacagcttgtggccgggtgtggtggctcatgcctgtaatcccagcactttgggaggctgaggcgggcggatcacgaggtcaggagatcgagaccatcctggctaacgcggtgaagtcccgtctactaaaaatacaaaaaattagccaggcgtggtggcgggcgcctgtagtcccagctactagggaggctgaggcaggagaatggcttgaacccgggaggcggagcttgcagtgagccgagatagcgctgctacactccagcctgggcgacagagactccgtctcaaaaaaaaaaaaaaaaattgactttcaacaaattgatagtgagcattaagggtttccaagttggatttgtaactcctcatcattccttgtatgacaactttctgaatatatgtcactatgtagtaaaattaaacactccaaactcatctttctgttgttagaagttttcagcggtacttccatgcaactttaaatctcactgctctctatggttgatgtcaaatgaccttcagtaatgactgagaattgaatacaaatagattacaaagccaaaatttgatgttaaatgactcaggaaattttagttgtattttcaattcaagtacttagtagcctacgtttgcttggcctctggttctttatggaaaataggctttgtagtggcattgtggagcaaaggagactgttacaccttaattaactttttttactgatgcaaataatttgaggatagagaggagggaagtagtgaaagctatgacctaaaacattgggaccaaatagaggctcacagatatttggattattttatgtgcttattattaaataaggaaagcattttgtgatatgtggaagacgctatgtgaagttttacctatcttctcaaagaccttttcttttgtattttcttttggtgtttcttaaagccaaacaaagaaatgttcttaaggagacagggtgggtttttctgtgggcctttgttggtttttctgtgggccatcgccctctaatggaattgatctctggctgtttgatttttttcatattgtatttttaaaatttgttgtacagtgccctgtgagcaccaagtaccactagatgaataaaacgtattatatctaaaatc

SEQ ID NO: 100271 - DNA, 723 bp, Homo sapiens
caccctccaatttccccagaacaagtcgtgaatctaccacaagaataaaagaaattctaggttctccctctgttgcccaggctagagtgcagtggcacaatctcagctcactgcaaccttcacctcccaggctcaagcaatcctcccacctcagtctcccaagtagctggactatgggtatgtgccaatgtgtccggaattggtgggttcttggtctcactgacttcaagaatgaagccgcagaccctcgcggttgcttggttgtcatatctgcctgttgctgtaagcaggacccaaatgaacaatgggcctgttcacactggagccttttccagaatgataccatctgcttgtgtgattcatccatctggagggatatgaagcgcaaaagccatagctgtttctcagccacagcctggctacaggaagaaaccaaacaagtctggaagctaccctcaaggcagaagaactagtagagttgagatctcatggggaaaacataggggataaagtcatggaagaagttataaaagctgtttctcatattatttctcttcactaaaataaaacagtaaagaagacactggataatgagaattactaaatgcagttcactatcttaaattaataatgacagttattgtgcaattatttttccatttgacatctaagttttgctaaaaaacatttcaaacttttttcttcctcaaagtttgtacaaga

SEQ ID NO: 100272 - DNA, 585 bp, Homo sapiens
acaggtaccttccaccagcaagactaatttttgtatttttgtggagacggggtttcaccatgttggccaggctggtctcgaactcctgacctcaagtgacccacccgccttggcctcccaaagtgctgggattacaggcatgagccaccatgcctggcctccattaaatctcatctacactttaagtgtatgggataccaagatgtgaaagacatggactgtaccttgaagaggcttgtagtctgttacacagggaactcagcagagtctgattgtgggcggttccctgacacatgaagtaaagaactatgagaccaggacagaatggtgaagctcatgctgcttgcctagttaagagtcaagccatcattcccctcatatactaagtgacttgtttttaattcatagtactttttgtttcactttataatattgtggtctttcccagttgctggtctggtgaagtgggctctgggcacctggctgtctggcttacccctcttcatacactccatgtctagcacatgtttcaggcacgtttcaggtgaggtttcttggaggggacatctgagctggacctggaaa

SEQ ID NO: 100273 - DNA, 890 bp, Homo sapiens
ggttttgtagagggtccaaaactctttagaacctataattcaaggaaaggctccactttggttttgcattttgtctggtctctttcggtgacagaatttatatcacaaggtgcacatattttggggaggctatggacagcccattgcacttgtgctttggtaggaagtacgtgccgttaaggggaaggagttagttactgattctagggaacaattgggtagaaagagatggactccctgtatttgaaattcagaactcaagcttggctctaagtgtttccttgctttgctgtgctccaagcgagtcactgagcagaaggaagcgagttgcctgagattcctcaaagcccgcagcccttttggaggttacattgttattctcagagcctttatgatccataataaagacctagcttggaccaatattaggatgagttatcttgctatgaacattttttaggtagaagttgctggtcccatcttgctcacaatcctccaaagtttggaagttactttccaggagacttagcttgcactgagagctgccctcccaccctctctccaaatttcctcttgggagtagcctaacaaggtgctgtcacagacccttgccagccacgatgaccccacccagaccatccctctgctgtttcactctttgatactctctggagctctctggggaggggtgagacctgctgtctgctttgtactgtttgcccaggtcttacagtcatggctggctcctctctctgagaactgggactcctgaacttggtgaaatacctcagccatcgatcatgttaaattatcggggacactcattaacacatgtgagtctggtccagatggactctctctctttctgccctgaccgtgagggagaccgt

SEQ ID NO: 100274 - DNA, 783 bp, Homo sapiens
ccctcctctctccatcagcgccacccgtgtggggcccaaaaggagggagctttacctctgtcccccagcctttggagtgtcaccaaacaagccattcgttcaccaaatacttattaagtgcctgacaacggaaatgtaacggcagaatcaacggtttctgggtctgagatgttgcatacaccctctcagtccctgtagcctgagatggagtcacgtgagaatccacagcaagtcctaaccagggatgggtctgggtgattaaggaaggttggcttcagaactgggccaggggcactgctttgcttttgctgttttgatcagctctctgcctgcaggagacaaggaaaatcaatgggaacagaaattgcctgtctgctccactctggttgaagaaaccagtctgactgtctctgaggctatggagcagtccatcaagaatgaaagccctctgccaggcacgttggctcacacctgtaataccagcactttgggaggccgaggcaggtggatcacttgaggtcaggagttcgacaccagcatggccaacatggtgaaaccctgtctttacagaaaataatactttgcaaggcctcagaaactctgctatccacaggcaggtcttacagtcatggctggctcctctctctgagaactgggactcctgaacttggtgaaatacctcagccatcgatcatgttaaattatcggggacactcattaacacatgtgagtctggtccagatggactctctctctttctgccctgaccgtgagggagaccgt

SEQ ID NO: 100275 - DNA, 259 bp, Homo sapiens
gccatggtccagtgcatgcagccttggcttctcttccctggacctgggaagcctgcagatgctggaagcagcccagctgtggcccctccactgttcttgccccttatgtgtgggtgtggaaagaactctcattcagagacatggtgattttgggatggagacgttgcttcctccaaccagactgcttccttcagtttccactgcctgggctcatgcatcagtaagttctcctactagaaagtttatttgcaaaaagcca

SEQ ID NO: 100276 - DNA, 163 bp, Homo sapiens
ggtgactctagcaggatccacacactgggttcgagttctgaccggattctcatgtgtggcatcaacgaggagagtcacttccagcagtggagccctcccacttctgccagtccaactgccttttaaagggaacaagcctttccccctcggttagccccttctg

SEQ ID NO: 100277 - DNA, 940 bp, Homo sapiens
atgtgttttcagaggcaaggtcacaaaagggaatgcagcttctatctggttctcttgggatggttgttcttgaaacccagccaccatgctgtgaggaagtccagacaacctatggagaggcccctttcaattttactgaaagttctctctcaaaccagaaaaagaaatgaagataaaacagataccaatgtaacttttacctgacaaaacaaccctccaaagaatcagcacaatttaaaagtttagaataattctttttgtggaagctcttataggttgaggttgtgctcaaaataaaagaaacagcctgaagattaacatagaagaatgttttgaaggaagagagaaaaagaaggagaaataagaagaggaggaagagacggaaggaaaagggggaaacaggaagaggagaacaaagaggcaagaggaaaaacaagaactattactactactactgtgtggtcagttacatctgtactacctttagatttttttttccttttggagtagattaatgcataatccttgctgcactgactcatttaggttatacctgtttttcactctggcttccccaaggtccacctgcatgttcataccaatcattatctagacatgcatgcatttctagacaggctggaaatctccttttggatgtttcaggggcatctcaagcataatatgtccaacagaatattgatcttgccacagaacatgttctatgcatcttaccaattgcactttgtggtatgaacatcccatccacgtactcacatgggaaactcagggccatgctggggtgcttctcttccctacccctggctctgtttcaactggcctaacatcaagtcctattagctctggctccaaaatgtaattcctattactccattcctctccaataactccactgaaaaaacctccttctaaactaccatct

SEQ ID NO: 100278 - DNA, 298 bp, Homo sapiens
cgtttctcctctgctttcaaacacggttatttcttttgattcacatttcactcttgctcaggaggcagcaggagggacaatggaaaatcagttcataatcatctacaaagaaatccgttcccgatgtctctttatgccgaggctgatctcgggatttgcacgctcgtttctggcacaaatcctctgactgtcaactcaaatccagtcagtgggattcagacctttgtgcagctgtttacaaaaggctcagaaccatgaaatccactgaggggcgggtaacgtggattttgcaaaaccg

SEQ ID NO: 100279 - DNA, 409 bp, Homo sapiens
agaggcggccctggaaatttgtggaattttaaagtgggcattgcgctgtgcataaatttagagtaagagtttgctgcaatcttccctaatcttaaaagggacagcagttgcaaaataatatttcacttacacataaaatatacactgctactggatatctaggtacctatggtctgggactgggtaatgcaggtatttcttcctccatttaacagatttccccaacatccatccatctactcagtcattcaacataatggtgatatatacaaggcattctttggagtattgaggattgagggactaaacaaagttgctggcctcctggagcttatgacctattgaaacagaaagacaatttataaataaataaagacaaaataatctaattttggttacttataattgc

SEQ ID NO: 100280 - DNA, 1144 bp, Homo sapiens
ccccagggtaaaggtggaggactgaggagccttgttacagcctggtgagggtggaagtataggcgtttgttggcggggataggaccatagctttcttctgtggtctttgaagtaggattgtggttttctaaacattttctgtcttgctaggctgctcccttcccagtcctttggctaaaaaaagcagatttttcttggggctttttttttttttttggtctgtgcctgttgggtttccgggttgccagcttctctagaacccgatctgggatagatgaggcaataagaaagcccaagaaagtcactgctgtgttcttcctcaggttctgaggtccctggccagtccattctctctccaccttttagaactttcttatgtttgctttgtatataatatcccggatttttagttgtagttagtgagagcgataggagaaagtagtgctccacctttcccgtgacatcctggtgcttgacactgaaatcacacatcaagttgtggtatatatagggtttgtggtatataacctaagggtttgtggtatatacaggtcatttgtcctgaagataagctgccaatttgataggtagaaactatcagcctgcttcatctagctttgaaggaacaatagtttataaattgaggaaacaccagtatttaattgtaggttataaactggagaagaatagctatgactaagaatataaactatagggttacatttttttatttgtatttttgtttgaaaaacatatgagaagcactggagaactggactcagaattttggatttttttacaattatatattatgtacatgtggctatctgttcactttaatttgccatatgacatatgatatcatagagaatcaacaaaataaagaatgaaaataactgagatttgggacaagtcaccttcatcctttgaaatctgtttcctcatagatatatgttttaaaatttaatgcctacttgagaatgattgcaagagttaggtcgaaaatggatgcaaatgtggtttgtaagctatcaggtgctacgtaactattaggtattattcatatagtcatttagaagacatatccatcatgtatgcttcacagtggtgtagcccaataaaaacaactgtgaatataaaagaa

SEQ ID NO: 100281 - DNA, 389 bp, Homo sapiens
gttgagaagcttgtgactctacgcggctcagagaggagtttgctagggttcttgtctgtgaatatctccgtgctgaccatgctggaattggatgattctgcaattcgcgacctactgcaggggtccgtttagtaacgtctggtctgtgatctttgttctagacctctagaccccaagatgtgaacagtgcacgtgattaatgtgatctatgcgcatgtgttataggccccaggtaggtgtatattatcgcaagtatgtctagacactggtcaagatgatgagaatgaatgacgatcgagaacagtagagaattggcttctttcactaagtgaaaacttaaagttttcttcacatctcttcatgaattgatagcacatttctttttagta

SEQ ID NO: 100282 - DNA, 579 bp, Homo sapiens
tatggggtagggagaaaaatgtgatgggggataagcacacacggggctccaaagctacggtaatgctctatttcttcatgtggaaatgggtatgtgcagaaaaaagtgaacacaagccggtctgagcctgctaccctcagaaggcttacttgcaaggtcagcctttggctggtgtctagaagttgaatttcaggaaagttctcaccacccctagaaccaataaagagtggctcattgtgcttaaactgtttgtacaatgtggtttatgcttaatgcccgccttccttctgggagtctgaaatttgaaacctgttaaaacagggtacctacagaaccagcctctagtaaaaatcctgggcaccaggtctctaataaatttccctggtagacaatatttcacacatattgccacacatattcattgatggaggaatcaaggatgtcctgtgactccagtgggagaagattcccggaagcttgtgcctggtttcttctggacttcaccccatgtgtcttttccctttgctgattttgctttgcatcctttcactttaatatattatagctatgaatatggct

SEQ ID NO: 100283 - DNA, 921 bp, Homo sapiens
aagacctgtctcaaaaaaaaaaaaaaaaaaaagattggactagatgacctttaaggtcccttttaactataataagttatgatttttctcactcatgagaaatgtttatctccgtagtaaataagtaaataaaaattagttcatatgttccagtgttctctggaaagtagacgtctttattacagcatactctctttaccacaggatttgcaataattttgtaggttgtcttaaaagctctgggtcttggagggtagctcatgtctataggtgcagcagggccaggagggatagcttaaccagtattatacttgagaataaatttagcatgataataatgaatgagaaaagaaggatgctgaaaactatattgtgatcccatttttgtaaaacaagcaatgtgaagaaacttccaaccctgatatgtgggtgtgtgtgtgtgtaaaatctgtgtaagattatgtgggtaaagagaagaatatggaagaaaccacactagatggtttttgtagatttcctgagtcagtagcagggcaggaggaagtttagataccgagttgggaagaagtagagtgcagaaaagagatattcttaagtaaaaccacacatatgagatctcatttgtgtaaaatgatatttttgtgtattcataaaaaaattaatggaaataccacctgcaggccttttccaggtgaacaaaataaaaaatcctactcatttcagtcctttttttttttagagaaggatgtgggggatttgtccctatgtctctgatgttagaaacaggatttggggggcgctgggcgcagtggctcacgcctgtaatcccaacactttgggaagccgaggcggatcacctgaggtcaggagtttgagaccagtctggccaacatggcgaaaccccatctctactaaaaaaaa

SEQ ID NO: 100284 - DNA, 567 bp, Homo sapiens
attaatgattggacctattaccgtacaccgtatcttttacataaggaaatgtctttgaacacctagagtaaaaagtattcaagaagagaaatgatagatagtgcctgttttcagacaaggcagaaattgggtgttgctgtcatagttacacaagcaatctaatcatgatccaagagggaggtggcaggtagtatatggagattagatgtcaaagggctcagctttcacactaccttgtacaaacttcacaaggtcaggtcccagccacctggcaaaggcccaacatcctgagacattgtagaagaagcatgaaatggcctctttcgttttgtctcttcctttacccctgtcagagtccgaggtgactgatttgagtgattgcagtttagaaggggtttggagaacttgaagatgcttcccaaaaggacaagagtatagaagtggggtcgggcacagtggctcacgcctgtaatcccagcactttgggaggccaaggtgggcagatcatttgaggtcaggagtttgaaaccagcctgaccaacatggtgaaaccccatctctactaaa

SEQ ID NO: 100285 - DNA, 3128 bp, Homo sapiens
  misc_feature (98)..(98): n is a, c, g, or t
  misc_feature (146)..(146): n is a, c, g, or t
  misc_feature (284)..(284): n is a, c, g, or t
  misc_feature (399)..(399): n is a, c, g, or t
  misc_feature (649)..(649): n is a, c, g, or t
  misc_feature (700)..(700): n is a, c, g, or t
  misc_feature (940)..(940): n is a, c, g, or t
  misc_feature (1255)..(1255): n is a, c, g, or t
  misc_feature (1533)..(1533): n is a, c, g, or t
  misc_feature (1538)..(1538): n is a, c, g, or t
  misc_feature (1557)..(1558): n is a, c, g, or t
  misc_feature (1690)..(1690): n is a, c, g, or t
  misc_feature (1721)..(1721): n is a, c, g, or t
  misc_feature (1738)..(1738): n is a, c, g, or t
  misc_feature (1748)..(1748): n is a, c, g, or t
  misc_feature (1798)..(1798): n is a, c, g, or t
  misc_feature (1869)..(1869): n is a, c, g, or t
  misc_feature (1922)..(1922): n is a, c, g, or t
  misc_feature (2279)..(2279): n is a, c, g, or t
  misc_feature (2433)..(2433): n is a, c, g, or t
  misc_feature (2445)..(2445): n is a, c, g, or t
  misc_feature (2484)..(2484): n is a, c, g, or t
  misc_feature (2494)..(2494): n is a, c, g, or t
  misc_feature (2496)..(2496): n is a, c, g, or t
agatggagtttcactcttgttgcccaggctggagtgccatggcacaatctcagctcaccgcaatctccatctcttgagttcaagcgattctcctgccncagcctcctgagtagctgggattataggcatgcaccaccacacccggntaattttgtatttttagtagagatggggtttctccatgttggtcaggttggtctcgaactcctgatctcaggtgatccatctgcctcggcctcccaaagtgctgggattacaggcatgagtcactgcgcctggcctgntctcttctctttactccaaacagcatgtctctctcttgctctgttctgagccacctggagctggggctggggtgacacaagcaccctggtggccaccatcactgagattatgccnggtcagacctgaagtgagcacagcagtgggtcttacccaaggcctgctgtaaccactacctggctaccacctgtgtttgctcaaggcgctgaggctctacaaccagtgggtggcaataccagccaggcttgtttccttcccttcagggtggcaggttcccccaggccctgtgtgggtcaagaggtgctatgcaggagccagtgactggagtaaaaaaactcagaagtctacctggtgttctaattgtacngtggctgagctggcactcaaatcatgagatgcagtcctttccactcttccntcccctttccacaggcagagaagcctcaccccatggccaccaccaccaaaggcccatggggagtactgccaggctactgtcaatgttctcttagagaccaaaggctcttgagtcagcttgtggtgaagctgcctggcctgggattcacccttcagtgcagtgggctcccctctggctcagggaaggtccagaaatgccatccaagatccaaggcctggaatcagggatcccaacaacccncttggtgcctaccccactgtggacaagctggtaccgaacatgcaaaagtctcttttgcttttccctcaacttttttcaagcagaaggagtctctccctatagccaccacagctgagaatgttctgagtttcactcaaggcctatggtgtactatcagggtattgctgctggttattcagggcccaaggactcttcagtcagcaggtgatgggtccttccagaactgagtcctttccttcaaggcagtgggtttccttctggcccaggatgtgtttagaaatgtcatccaggagctagggcctgcaaaggggaccnaatgactatgactggtggcctatcctactgtggctgagctggtatacaaagtgcaagataaagttctctttactcttccctctcctcacctcaagcagaaggaaggggtctcttttggagccgtgagctgtgctgcctgggattgggagaggggtggcacaagcactcccttagctgccctaactgttgtcttactaggttacatgcccaccaagtccactggctctgagcccagctcagtactaggaattgcctcagagttgcagtccttgtggccnagacngcccttcaagtttacttannattccagagcattttagcccacagtcgtgaggctcactggaactcaagttccagccactgggatgggtaattcccccctgactagagctgactatttatttatttatttacttattttgagatggagtttcnctcttgttgcccaggctggagtgcaatggcncaatctcggctcaccgngacctccacntcttgggttcaagctattctcctgcctcagcctcccaggtagcttggatnacaggcatacaccaccacacccagctaattttgtatttttagtagagacgaggtttctccttgttcgtccngctggtctcgaactcctgacctcaggttatccgcctgccttggcctcccaaantgctgggattacaggtgtgagccaccgcacccggccaaaactcaagttttttaagagagtgggcaggaagatccagctcaccttactagccactagagctgatttaaatgctccctctgtgggtgggcatcagctgaattcagcctggttttgctttctacttgttggtagaagagctgaggcaggactggcttatctgtcataatataaaagagtcttggaagatgtctggggtccagggtctaaaacccctcgtggcctttggaacaccaaactctgtgccaaggggtggaaggctgccctgccgcaccacaaatctaagcccagggcataaaacccctcatggcttggatggantccagggcttagggcataaaacccctcgtagcctctggaatgtgcacagacttgttggttgctctcccaggttcgtaaacatgttctctattatctccaagcagcagagcatattatatatgcatcaaagaaaatgctaaaccatcacagatangcttgatgcacnactacctttctaacctcacaccctcacctgtttaccccnacgtcctcangncctgcttctttgtttgatcaccaataaataatgtgggctcccagagctcagggccttcgcagcatccataccagcgttggccccctggacccagcatatgcactcttaacttgtcttttctcattcctttgactacgctggagtttgtagcccccacggcctggtgttgggtctgatcaccccaacatttctggcacccaacatggggctacgaacactccggtgaaggaacactagagtgtgcggaagcggaggacacattgtcagaggacacccaaggacgactgaaagaagcttggtggaattcatataaagttgcgagtttcaggttggttggctctgactgatcacctgtattatggaccatctgtgtgattatggagaaaagttcaggacaccagcaacctacattggataggaccacctctgactccagggattgccactcaatctttctgagattagcacccacatccaacaaggtgtgatcctggtgatctttgaaaaaaaggcactgaaacaaccatgatttaagtttttggtattatgaatgcatgagaaattttctgggaaaaaatcataactatattaagaataaaaaataaaaaattcctaaggaaaatacttgatct

SEQ ID NO: 100286 - DNA, 3663 bp, Homo sapiens
  misc_feature (98)..(98): n is a, c, g, or t
  misc_feature (146)..(146): n is a, c, g, or t
  misc_feature (284)..(284): n is a, c, g, or t
  misc_feature (399)..(399): n is a, c, g, or t
  misc_feature (649)..(649): n is a, c, g, or t
  misc_feature (700)..(700): n is a, c, g, or t
  misc_feature (940)..(940): n is a, c, g, or t
  misc_feature (1255)..(1255): n is a, c, g, or t
  misc_feature (1533)..(1533): n is a, c, g, or t
  misc_feature (1538)..(1538): n is a, c, g, or t
  misc_feature (1557)..(1558): n is a, c, g, or t
  misc_feature (1690)..(1690): n is a, c, g, or t
  misc_feature (1721)..(1721): n is a, c, g, or t
  misc_feature (1738)..(1738): n is a, c, g, or t
  misc_feature (1748)..(1748): n is a, c, g, or t
  misc_feature (1798)..(1798): n is a, c, g, or t
  misc_feature (1869)..(1869): n is a, c, g, or t
  misc_feature (1922)..(1922): n is a, c, g, or t
  misc_feature (2279)..(2279): n is a, c, g, or t
  misc_feature (2433)..(2433): n is a, c, g, or t
  misc_feature (2445)..(2445): n is a, c, g, or t
  misc_feature (2484)..(2484): n is a, c, g, or t
  misc_feature (2494)..(2494): n is a, c, g, or t
  misc_feature (2496)..(2496): n is a, c, g, or t
  misc_feature (2826)..(2826): n is a, c, g, or t
  misc_feature (2976)..(2976): n is a, c, g, or t
  misc_feature (3001)..(3001): n is a, c, g, or t
  misc_feature (3193)..(3193): n is a, c, g, or t
  misc_feature (3384)..(3384): n is a, c, g, or t
  misc_feature (3649)..(3649): n is a, c, g, or t
agatggagtttcactcttgttgcccaggctggagtgccatggcacaatctcagctcaccgcaatctccatctcttgagttcaagcgattctcctgccncagcctcctgagtagctgggattataggcatgcaccaccacacccggntaattttgtatttttagtagagatggggtttctccatgttggtcaggttggtctcgaactcctgatctcaggtgatccatctgcctcggcctcccaaagtgctgggattacaggcatgagtcactgcgcctggcctgntctcttctctttactccaaacagcatgtctctctcttgctctgttctgagccacctggagctggggctggggtgacacaagcaccctggtggccaccatcactgagattatgccnggtcagacctgaagtgagcacagcagtgggtcttacccaaggcctgctgtaaccactacctggctaccacctgtgtttgctcaaggcgctgaggctctacaaccagtgggtggcaataccagccaggcttgtttccttcccttcagggtggcaggttcccccaggccctgtgtgggtcaagaggtgctatgcaggagccagtgactggagtaaaaaaactcagaagtctacctggtgttctaattgtacngtggctgagctggcactcaaatcatgagatgcagtcctttccactcttccntcccctttccacaggcagagaagcctcaccccatggccaccaccaccaaaggcccatggggagtactgccaggctactgtcaatgttctcttagagaccaaaggctcttgagtcagcttgtggtgaagctgcctggcctgggattcacccttcagtgcagtgggctcccctctggctcagggaaggtccagaaatgccatccaagatccaaggcctggaatcagggatcccaacaacccncttggtgcctaccccactgtggacaagctggtaccgaacatgcaaaagtctcttttgcttttccctcaacttttttcaagcagaaggagtctctccctatagccaccacagctgagaatgttctgagtttcactcaaggcctatggtgtactatcagggtattgctgctggttattcagggcccaaggactcttcagtcagcaggtgatgggtccttccagaactgagtcctttccttcaaggcagtgggtttccttctggcccaggatgtgtttagaaatgtcatccaggagctagggcctgcaaaggggaccnaatgactatgactggtggcctatcctactgtggctgagctggtatacaaagtgcaagataaagttctctttactcttccctctcctcacctcaagcagaaggaaggggtctcttttggagccgtgagctgtgctgcctgggattgggagaggggtggcacaagcactcccttagctgccctaactgttgtcttactaggttacatgcccaccaagtccactggctctgagcccagctcagtactaggaattgcctcagagttgcagtccttgtggccnagacngcccttcaagtttacttannattccagagcattttagcccacagtcgtgaggctcactggaactcaagttccagccactgggatgggtaattcccccctgactagagctgactatttatttatttatttacttattttgagatggagtttcnctcttgttgcccaggctggagtgcaatggcncaatctcggctcaccgngacctccacntcttgggttcaagctattctcctgcctcagcctcccaggtagcttggatnacaggcatacaccaccacacccagctaattttgtatttttagtagagacgaggtttctccttgttcgtccngctggtctcgaactcctgacctcaggttatccgcctgccttggcctcccaaantgctgggattacaggtgtgagccaccgcacccggccaaaactcaagttttttaagagagtgggcaggaagatccagctcaccttactagccactagagctgatttaaatgctccctctgtgggtgggcatcagctgaattcagcctggttttgctttctacttgttggtagaagagctgaggcaggactggcttatctgtcataatataaaagagtcttggaagatgtctggggtccagggtctaaaacccctcgtggcctttggaacaccaaactctgtgccaaggggtggaaggctgccctgccgcaccacaaatctaagcccagggcataaaacccctcatggcttggatggantccagggcttagggcataaaacccctcgtagcctctggaatgtgcacagacttgttggttgctctcccaggttcgtaaacatgttctctattatctccaagcagcagagcatattatatatgcatcaaagaaaatgctaaaccatcacagatangcttgatgcacnactacctttctaacctcacaccctcacctgtttaccccnacgtcctcangncctgcttctttgtttgatcaccaataaataatgtgggctcccagagctcagggccttcgcagcatccataccagcgttggccccctggacccagcatatgcactcttaacttgtcttttctcattcctttgactacgctggagtttgtagcccccacggcctggtgttgggtctgatcaccccaacatttctggcacccaacatggggctacgaacactccggtgaaggaacactagagtgtgcggaagcggaggacacattgtcagaggacacccaaggacgactgaaagaagcttggtgggtaagctgagcactcagaagaaccaggntaacaatggaacagaatgaaagtaaatattctgcttatttaaatttcttaaggcatttattatggagagggggagtgaaagttaatactcagaacttattaacactctttgatacagtagagcagttttgcccatggttcccagaacaanggacaatggagctagatgaatgggnaagaattggcagaaattttaaaaacgcatataaagaaggagccaaaattccagtttctgtttggtcagtgtgggagttgataaaggcagttcttgagccatttcaaacagatgacaaggcagattcagatgaggaagaggtagatgagtgtaaaaaattaacttcagattctgaatatgaggaacagcaacnggaagaaattaaagaaaagaaatggaaactgaaaaaggtatattttactagcccttcggttccacctgctgaattaagtgaatggccacctcctccctctccccctaatgggtgagaagatgaattagctgtaaaacttaccgctccggtagctgcaacattaaaacctggagcaattggtgatgcgatanaaaattttattcagaaggctagaactgaaggagacctagaagcatggcaatttcccattactataatccagagaggaggacagaatatagctagttgggccacctttccttttaagttgttaaaggaattcaagcaagccattagtcaatataggccaaattctccttttgtacaaactttactaaaaaatgtggctcttgataatagattaataccatatgactgggatactttaacaaaatctgttctcactccatctcagtntttgcagtttaaaa

SEQ ID NO: 100287 - DNA, 481 bp, Homo sapiens
  misc_feature (481)..(481): n is a, c, g, or t
gaactcgaaatagaagaggtttaagtatttgaataagttgggaaaaaaaggaaaaatagtcttccctgcccttgtcactgatggtgacactacttgtaattactgtattttttggcagaacactcagatgaacggattcctatgctgtggacttttatcattctttttgatggctgatagtagaaagcacacagtaggtactccataaatgtaagactatggcagctgtctagtacaagtgcttctcactgattcttggttaccaggaaaaccagaaagcccgtcacttgccttgcctgcaaaggcgagcctaaagaaatttctctaaccaaaattggcagggtctttccaccacaaaaggctcttggaaatataacttatggggcttaaggctaatttgagttgaagggtatttgtaatatttgatttgcttttagcagagaaaacaataaaagaatccaggaaaagtagaaaaaaaaan

SEQ ID NO: 100288 - DNA, 219 bp, Homo sapiens
gagagccgagatcatgccactgtaccccagcctgagcaatagagcaagactctgtcttgagcggttgcggaaagagttaagctattaatagaagtaaaccagctcttgtgcagatttgcagcccaggttaatgttgcctgcttggtaaatggaagttcaaatcctgaatttggtttaaggtggtcccaatttagtaatctaccaggaacatggcagaag

SEQ ID NO: 100289 - DNA, 882 bp, Homo sapiens
atttttagtagagatggggtttcaccctgtaaagacatgactttgaaggataggaaagctaactaaccagtcataagtgaatatcattgcagggctttttagcatatgggggtacttttttgacttcctgtaggatgttcagtgttgtccaagtaggtctcaaatagaaccccagtgaagtcatattgtttcctttaattcttacttttggggcaatgcagggtttctcttcttcttttttttttttttttgagacagagtctcacttcttgccacgtgcacctccaggcttggcttgacagagggagactcgtgtctcagaaaaaaaaaaaaaaaattaggtttcaagtctgtgacccaccgtgtgaccagccagagggtgcccttctcttatatagtgtgttcatacctcagtggggctctttgggttcttgcccaggtgattaacaatgggggaataacgccttgtctatacacattcttctcatttggtagaaacccttctccccgtgttccgtgaaattataactgtaaaacttccataaagattttttttaaatataggctatttattttcccttgtgaaacaggccataagcggtttggagagcaaccttttaacagagcgccctttatgtgtttttaacatctaacccacaagcggagcacgctaaacgcgggctcatattatgagggcaaatattgcggggtaaattccctctatatgctcaatgtcgagatatggggccagacatgttttttgaaacaattttttcccccccaaggtgaacatcgttcaaaataaatttccaaaaacaacacattctctattgagggacccccttcaacatttgttgttgcgcccagtgtttgtccacaatc

SEQ ID NO: 100290 - DNA, 200 bp, Homo sapiens
gtgggagaagtgaagttttagatttgatactatctggacagtagctattgtctattgtaaattctcagagaatctatactgtgtataataaatatgaaacttaaatgttcatggtatctatgttgactatatgtgttttagtttgacttctccctatagattggttttgctgtattttacttatttcttgaatgttatca

SEQ ID NO: 100291 - DNA, 250 bp, Homo sapiens
ggttcatgtgtggaaaactaaaacgcctaaatgctcaagtagcattttactgtagaaatacaaaatctgaaattatatatcaagctattttccaaagctgtaactttttataccctctcactttgtgctttccttccagatcctttcagagccattttcatacacaatttttattttttgttttactttgctggcttttttgatttattaactttaaatatgttttttatgttaggcacccaaaccccaa

SEQ ID NO: 100292 - DNA, 153 bp, Homo sapiens
tagggttgttttgagggggaaacatgtccattcctgcaaggtgtataggtctgtgacccgtgcgtggtgagcatgtttataactcaccctggaatcttggcaggacccccgtcaagatgccaaggcttcaggaaccagagacttccagggttt

SEQ ID NO: 100293 - DNA, 174 bp, Homo sapiens
agagcaagactctgtctaaaaataaataaataaataaaatagggcagagattactgggaggggtaagtaggccttttaactataatggaacatttttttgtgtgtgtacttcttaccaccagtcactctttagcttggggtacaaagttgaaagccacctttgtgagattgaac

SEQ ID NO: 100294 - DNA, 393 bp, Homo sapiens
gttatgaaatcaatttagtggactatgagtataaaacaggaaagaaaacatttgctattacataataagggtgagtgttgttttttgtgactttagtttttgttcatgtgtatatgtgttaggttatgatataaagtgtattccttaatgtggattatagtttgaaaagtttgaaagccagtgcaataaatggtattttcacaaatagctaaccatttggagaaagcattcaaaaaggatacaaaaatatacagacagaataaatgaaagactggactaaactatgtcagtggaaaaatgtaagaatagtagtagtaagtcattcaatagaggagagttcaaagcaaatgtatgaaacaaagtatacaaggttgtagaataacagcaaataat

SEQ ID NO: 100295 - DNA, 1312 bp, Homo sapiens
gtcacactgcagaaaagaaagtgttgggactggtctctaagctcgccctgcagaaacagcgagctgtcctagctgtcctgggaatgatggggccacagactacatggccaagagcaggcagagcagctactgtttccctagggccacgtgtggaatgagtcacttcatcagctcaccacaactgctggcctggcacctgggtcctacggagagggcaatggcaggtaaagtgccatcacagaaccaccaggcaccgaagaccgcgttgcctgcttggacgatatgggcctggctcactgcagaagagaggcactgatgctagagactttcccctgggccatatgtatttttgtcttgaaagaggagtcgtaagggtttgcctacccaaaagctattttgtttcatatttacatttttagttctttctccattaagaaaacgattagtgaaatgaatggaattcgccttctttgctgctattgcttatgtgttcctatttcaccatcttttgtaaataacagtgttgttgctgtcagggcacttctccctcactgggcacgtgcctttctgtgctgtggccagcccaccatcgcctgtcctcacctgccatccataccctagcagagccgtgctgctctgagggtgccgggtggggctccattcttaccctagcaaactcaccagaacaaagcccacctgcccaaccctgtccttgtctcatttctcagcttcccgaggctcccttccatacccacagaggcaggactgctagagccccactcatgagaatcacagtcatttcccagcttcctggggcttccttccatgcccgcagaacagaggcgggactgctagagccccactcatgagaatcacagtttccacagagaagaccagtctagcttggactgtgggttcctggttttgcagatgtagagtggtgaaggcctaaccgaggagaggaaacaggagtgtaacagagtctccattccaggaccagcatctcttccctccccttcaggggtttaccttcctgaacttctcagtgtatgaaacacagcaggggctggggaactatacaacccagaggtgtgtttgtttcaagtattttttagagcagtttcaggttcaaaattgagcagaggctgggcgcagtggcttacgcctgtaatcccaatgctttggaaggctgaggcaggctgactgcttgagcccaggagttcaagactggcctaggcaatatggcgaaaccctgtctctactaaaaatacaaaaattatctgggtgtggtggcacacacctgtagtcccag

SEQ ID NO: 100296 - DNA, 383 bp, Homo sapiens
ttcctccatccttccaggacccagagccagagaggagcccggcttgcttgtgattgttgtggagagtagtgagtgacagttataggaagttgtgcctgggggcctatggtggaaagatactaaggtagaaaggctttcagggcctgaaggtggggaagacttgggaccagtatcccgacatgctgatccctggacactctctgccctgccttgtcgctgcttgctccttctggcccccctcctcccagtctctttcttcagctgcagatgcagatgccaactgggcaaagggagtggtgctgctctgcgcctcctggcgtttgccttctgttccctgtaaccagagacacggatccgggtgtgtagcctgcattctgtctgag

SEQ ID NO: 100297 - DNA, 347 bp, Homo sapiens
gtgtttgtttctctttccaccataattgtaagcttcctaaggcctccccagccctgtggaattgtggatcaattaaacctctgtcctttataaataacccagtctgaggcagttctttatagcagcgtgagaatggactaatacacctcccttcttgagtctggaagaatatgtgaagggagattgctaaggacttatttacagaatggttcttaaagtgcttgggcaagaactatgtatttgtggaggctggtagtgtttcagtgaatctgaaaacctttgtgacatgtgagaaaggtatgctgtctctgaaagctaagtgtattatgaaggatctataaaggcca

SEQ ID NO: 100298 - DNA, 266 bp, Homo sapiens
taactacaacaggcagttttcctctgttgtacgctgggaagatgctgccaagcagcaggatcaccagcttagctgtgtgtggtgaagttatgcaaatacctccccctgtcaactgtggcagcaaagtccccggaaggacttggactgtcctggtttgatatatgctcattcccccatcatgcactgtggccgggaatcaggaactgtgactggtctgacctgggtcatgtgcccacctctggctggtaggaatggttttgattttg

SEQ ID NO: 100299 - DNA, 1199 bp, Homo sapiens
tccctgcccccctgcagtttcccatttgtctttcagtatgttaatatttttgtgccatactggttttaaactttcatgttgtcacatctgttaatcttttctttaggatttctggattttgtgtaatttttaaaaaggtcccctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatggcagagcagtcccttgggggatccagccctgtacaatgcatctcttcctggagaaagctggcctgctccagaccccaccattcccaggcgcccttggagtggactctactgatgacagacagaccctctgagagacaagaccctctgactctgtgatggaagatgccagagattttcctttggggtaattgtccttaaacaaaaccaaacagatgaaacacacacaggacttgtggctaaaaaggctagtttttcacttgcatttctcaactaacccaggttttacatgcatctgtgaatccttttactactacctctgtggagagatggagagacttcagataaacgtgaagctaatgagtaaaaccctctctgccaaaacctacactccactttaggcccttcttgaagatgagcacaatttttaaatactgagcacaatttttaaatactgacatcacttcctcttccccctcccaccccagctcagcagcctcaaatctacagagaagaagaattatggcatgaacattcccacagacccaccatctttaagacttgacctctgtaagtttaccaaagggctcctcacaattgtggtgggggttctggttcaaaatttggagcaaacatgaagtttttggaaacgttttctcatttgaagcctccagtatgctgtactattctggaaattaccttcaagagtctcacttcttgtttctgttgtgttttctgtgggcatcatgttcttcacgcttgcagtagaaggtgctttctcggtttcccagagtatccaacggctcacctttctcaagtgctggcagtagctatgcactcacgggctggtttgggtcgctggtgcagcagcgcaaatctgttgccttct

SEQ ID NO: 100300 - DNA, 418 bp, Homo sapiens
aaacatgttttcttatttgatgccacagctataagcctcctgtctaccagggagagccgtctgcaggaaccaataataagttctcccactggggtctgttttctgaactctttcttctgctcctccacccagccctccccaagtggggtaggaccctgtttttggagagatttgggagccagctccacttgatcctggcccacagcactgttaggtaccctggttgatggctattaccaccaggggctctgctgttttaaactctaaaccaggagtcagcaaacttttttctatagagggcaagaaagtaaatattttaggttttgcaaaccatactttatttacaaaaacaggttacaggccagctccatcctgctgtctgtttttgtacagcctttgagttaagaatgttttttta

SEQ ID NO: 100301 - DNA, 759 bp, Homo sapiens
  misc_feature (688)..(689): n is a, c, g, or t
  misc_feature (694)..(694): n is a, c, g, or t
gaggggcatcatgctgagacaggagagccaaaaatgcttgctgcttacgagagcggcagcagcagggagctctagacagctgggctagctcttctcaagggcagaggatgctcacggccattttggggcccttccatccattttgggacccttccaccccactcccggcctgacaccaggcctccctgtaggaaaaaatatgttaagattaccatgtgccaagaacagtgctggctctgtgagggcgaattcacttcattgcattctgctaccaactgtgagcagttacagagattatccccattttatagaggaggaaatcgaggctctgagcggttaagtaacttgtccagggtcatacagccagcaaggcagaaaacatgcaaggtgagactgagttgggatgagtgtgacacttgcctcaggtgcaaatttatttttttattttttgagctatgttctcactttgtcgcccaggctggagtgctgtggcgcgatcatggcttactgcggccttgacttcctgggttcgggtggtcctcccgcctcagccacccaagtacccaggtagctggcactgcaggcacgcaccacgacacccagctgattttgtgtgtgtgtgttgtgtgtgtttgggttgtgtgtgtgtgtgtttttgagacggagtctcactctgtcacccgggagnnggagnttgcggtgagccgagatcgcgccgttgcactccagtttgggcaacaagagcaaaactctgtctca

SEQ ID NO: 100302 - DNA, 128 bp, Homo sapiens
tttctccacagtgctctagggcagctgtggagccaatgatgaaaaccacatgtttctgggcagccctgctgttgcacaatgccgccaaggggagggcaaaaaagaaagaaagaaagaaaaaaaagaaa

SEQ ID NO: 100303 - DNA, 353 bp, Homo sapiens
cataatagcccaaaggcagaaacaatccaaacttccacccgtgggtgaatgaagaaatgtatgcgcgggaacattcgccacgtgccacagcatggtgagccttgaaaacgtggtgcaaagtgaaaagcggtcacaaaggtcacgtattatgtgattccatttatatgaaacacccagaataggccaattcatagagacagaaagcagatgagggattgccagtggctgaggtgaggaagtcagtggtgattattaaaagggtgttttctggggtgataaaaaccttttgaaactagagaggtgatgggtgcacagcaccgtgaatgcagaaaatgcctcagaatcataccctt

SEQ ID NO: 100304 - DNA, 344 bp, Homo sapiens
aattgcaaaagtataacaagactaattgttgcaacaaatgaaaaagtgcaaacaggctgggcgtggtagctcacacctgtaatcctagcactttgggaggccaaggcgggcagatcatttgagtccaggagttcaagaccagcctggggaacacggcgaaatcccatctctacaaaaaatacaaagcttagctgggtatggtggcatatgtctgtagtcccagctatgagggaggctgaggtgggaggatcgctggagcctgggaggtcgaggctgcccctgagctgagattgtgtcactgccttccaccccggtgacagagtgagacccaatctccccaaaaa

SEQ ID NO: 100305 - DNA, 519 bp, Homo sapiens
aggttgccttacatcgctactcagagaattacatggcaaaaatgggcccaaacccggggctcatgagtgcatgttctcagaacccctaggagggatttcaaaacccaagtcccacatgattctggatcattaactcaacaagcagcagacatgcctctttaaggcaaaagttctatgttccatcagtgagcttctcataccaccgtgtctcctatattcttcagtaaaagactttaatatctaaaactcctttaacctcaaatcctgttatccccaaatgaggcaataacttactcggtgagatgtgtgcaccatcctgctcagtttgtgaatgcttcattacatttatatggatggtatattttccaagagctagataaaatatttcctcttctcaagtagctgcctactcatttggaaagaaaagacgtgaaagatgaacaaacagccattaagtgcaatcattggtgccttaaaactttaaggaaaataaaaatcactggaagtcggggcagtcac

SEQ ID NO: 100306 - DNA, 266 bp, Homo sapiens
agaacttggggcttaaggcacaagttagttgaaaagaatgtaaacagtcaagtccaaacttaggaagttcactgcaaagtacttcctgtgctgcacagggagccaaaacaaagtgaggcaaaacctatctcgccactacacaactgaaatcagtgctcttcctctactctaatgaatccttgcaattagattactagtgatctaaccaaactgaggctgaatttctccccttctgcaaaaaggcttatctataaactctaagtcag

SEQ ID NO: 100307 - DNA, 838 bp, Homo sapiens
ccagcctcagtctcccaaagtgctgggagtagaggcatgagcaccatgcccagcccaaaaagaaatcttaattaaaaaggtaagatgtataaggaaaccacttagcattaatgagcagtataaaagatgtcttatataaatggagagatccaccttacgcatagataggaaagactgatctgtaaccatgtcaactttctgcaaattatagttttaacacaatttcaaataaagtcacagtgtttgcttatttaaaaattgatatgattattctaaagttcacctaggagaatgagtgaagattattcaagaaaattgtgtaaaagacatacatgttacctgccctactgtttatgacaatgtacaaaactgaaaaatccagtgatatctttcaagaggaaaaagtattgtaaaagacagaatagaaaaatgaatgaaataaaaagtgttaaaacatccctaaattacatatacattcatgtgatttgatagtatttcagatccttggaaaaattaattattcaacaattagaaccagaacagttgatttacctttgaagagcatactcaggttagatttctacctcgtgtaacaaaattaattccaattcagttaaatgcccttttataaatcaacataaaaatgagtaccttagtagaaaatatataaagtttataaaccatttttaaacgaagaaatgtaagtgaccaacaagaatgtgaatttaaaataacatatttttttcatttatttactttgcaaagagaaaagctgcgaagaggttgtggtaaattggcctctcttctactctactgttgagggtgtaatttcgcataa

SEQ ID NO: 100308 - DNA, 870 bp, Homo sapiens
caaaggcgcttagaggatcccctcaacgctttattcattaatattactttggcgatagaatgtaaaacagattagaggataactaccagctaaaaaggctattatcatagttcgagtgagagatgatgagggcctgagctagggaagtgacaagataaaataaaagtacagatgaggaatattgctattaggaatcaagtgtctatgaccaagtggatctaagaaataagggggaggaaggcctgtctcctgataagaaaatttggtcattaaaagcgtgattacaatcatgtatactaagaactttactaaaagctggagatatgctgaacaagacaaacaccatcccctcacttaagaacaatctattgggtaaaaaagcagataggaaattacaataaagtagaagtacaacaataagaaaaacatagaaatgaagaaacccagaaggactaaaaaaaaactataagagcaacaactttcaaacaaatttccttgacactaacaagtcaagtaaaatgagaacctgaagttttttcagactaggcaatcagaaaattactgcagatctttaccagacaatcactaaaggtttttacccagaaatttcaactgagtagggaagacgcctaatgtagtatgatcaacatgaagtgcttaagggcggttaagttactaaaaattagcaatatgtaaaatgaaaggctactaaaataaaatattagagactgcttaacatactgtctcctgggaacctttctataatagtggcaatattgtctttccttacagttacgtatgtgcttactactgaagttttcaaaattaacaatgcattgtttagggatacatgcatgggtgatgatacat

SEQ ID NO: 100309 - DNA, 808 bp, Homo sapiens
agccagagggcagaagtgccctggagtgcagaccccagcagacactgaccaggcacaggaggatgaagtgagtttgttggggacagagaacagccaaggggcagccggcagtcagctcaagtcctcacaaagaagggcaataccacccgtgggccgggacagtcggctcgagggccagcagccaggaacgtggcgaagaacttggatctgaggtgggcccatggtgtagctgtggtgtgctagcaagagtggcctccaaacccaccctggaaggtgatccagagaccatagagcagaaaggcttccttctcagagtgagctgctggaagcccaccagtgtcagcagtgccaagaggagctggggtgccagtatctgtgtatcttcagaggcagcaggggccagtgtgccacatcttgccccagtcctgaaaggatagatggtatttggcctgtgacccttggctgaggagccatggtccggctctgccaggccctgctgctgttagtggccactgtggcccttgcatccagaagattccaagcctggggctcaacaaaggtggtgaggacattccaagatatccctcaaaactacgtctatgtgcagcaggcactctggttcgccatgaaggagtataacaagggccagctttagtataacaagttcagctttagggtgctgaaggttctgaagagccaggagcaggtgacagatagtttggagtactatattgaggtcaaaattggcccgaacaatttgcaagaaaatttcagaagatgaaaactgtgcatttcacagaggatccca

SEQ ID NO: 100310 - DNA, 302 bp, Homo sapiens
aaataaggggaaagagtacaaaagagagaaattttaaagctggtgtccgggggagacattacatgttggcaggttctgtgatgcccccgagccgcaaaaccagcaagtttttattagcaattttcaaaggggagggagtgtacgaatagggtgtgggtcatggagatcacatgcttcaaggatgacaagaggtcacaaggcagaaggtcagggcaggatcacaaggtcagcgcgaaactagaatcactaaataacttccatgtcccactgtgcacacattgtgagggttcaagagcagagaa

SEQ ID NO: 100311 - DNA, 509 bp, Homo sapiens
gatttggctctgtgtccctacccaagtctcccgttgtcttatgatcttcagtgttggagaaagagcctgttgggaagctattggatcacgggggcagattttccccttgctgccctcatgataattctgtgttcagtcaaaataggagatagtttgctgtataatgttaaaattcctgtcttcgttgaatgatgccccaaatgttgatatgaattacatagtgtgtcctgctgtgagcatcagaaggctatataggaaccatgatgctggcacctgctcagattctgggaaggcctcaggaaacttacaatcatggcagaaggcaaagaaaaggaaggcaagtcttacgtggctggagaaggaggaagagggaaagagaagaggtactacagatttttaaacaaccagatctgcgagaactccatcatgagaatagcaccaaagggatggtgccaagccattcatgaaggatttattcccataatccaattaccttctagaaggctcca

SEQ ID NO: 100312 - DNA, 692 bp, Homo sapiens
gatttggctctgtgtccctacccaagtctcccgttgtcttatgatcttcagtgttggagaaagagcctgttgggaagctattggatcacgggggcagattttccccttgctgccctcatgatagtgagttctcagtagatctggttgtttttgtttaaaagtttgtagcacttcccccaatgctctctctctcctgccaccatgtgaaggcttgcttggatacccttcatctcccatcatgattgttaagtttcctgaggtgtccccagccatgccagctgtacagcctgaggaacagtgaatcaattaaaccctttttctttataaattacccagtctcaggtagttctttgcagcaatgtaagaatggactaatacagcatcttctccaaatttaagcacctgccttcccacaattcatttgagaattatctaatatttcactcatatgctcacaaatactaaggttcgctgtataagatcattttatatattccttattttattcattctgcaaagtccctgatgtttttcttaattaaagtctctattatttgcttttacacacaacataattagtttcaatgctaaagtaatattcttcaattttcataaacagatgggtagtttgtctacttctacatttttgtatcttaaagttaccagtacattgacatgtcctaacacaacag

SEQ ID NO: 100313 - DNA, 404 bp, Homo sapiens
cagtgtggtaaatgcaaggagagagggaagtataaggggaatgggggcagtgaaaggggtcagagccagctatccagaagcaacttctaactagagtaggtatcaggtgggctagaaaggctttttattctaggcagggagaagaacataaagcaagaacactaaggcaggaaacaaggactaaacctttttttttttttttttttttttttttttttgggggaaaaaaattttttttttttccccccgggggggaaatgggggcgaaattaaaattttttgggccccccaatttgggggaaaacccttttttttttctttatcttcggggggggggggccccgaaaaacaccccccggggggcccccccgaaaaaattataaaaggggcaaaaggttttccct

SEQ ID NO: 100314 - DNA, 476 bp, Homo sapiens
gtttcctctctaggaaaaggtagcatttgctggagtgagtgcagctgcaagtagtagtggacagctaaagattatacctcaagggttctggaaggttctcgcatgggctaaaaatgtacctctggtggagccgaagcccacatgggatgccacatgggatctgggcaaggaaaatgaatcagggctgacggcccagtactggtttcagccatgtcaatctgtggttagactagttacttacattgaggaatctttcctctttaagctcatttacttctatccttgtattattatgatgattttgttttggtcatttctcttagtctcctggtaaaaattctttgagggaaaaatccatgtttcctctgaaccaaggagaaagtctttactcacaggtagactagaataattagggacatcatttgattcttgaagcagtggttctccaccattttccactagaaacaccttatgag

SEQ ID NO: 100315 - DNA, 276 bp, Homo sapiens
tacccccctttctcttcacttgatttcatgtgaaagtcaaattatttgtatgactgctaccagaattttaataaaaattgacacaacataacccaaacaatataaattttcccctatttagccagactctaaatgctttagggaaaaagaaaaacgtgcagtacataatttaattaggttccaacaactcttcacagattcatatatacttctcacctgtaacaactcaatagagaaaaaaaattcaaggatgaaaaggttttatttacttctttc

SEQ ID NO: 100316 - DNA, 357 bp, Homo sapiens
tgtatttttaatagagacggggtttccccatgttggccaggctggtctcgaactcctgacctcagctaatccacccacctcgggctcccaaagtgctgggattacaggcgtgagtcaccacgcccagccccattcctgacttttacttactttctgttgaggatatcgataaccattaaatttccaatatattccattaatatgtagcagcacaataaaaaattatttacatacctcctttataattaaagcatggttaagacatgaatgcttttctccatttctttttaaaaaattttacatttgagacaaggttctcctctgtcatgcaggctggagtacagtggcacgatcatg

SEQ ID NO: 100317 - DNA, 624 bp, Homo sapiens
atcgttggcttcttcttcagatggagacgggagagaagaaaatagtgggtatcgtgtattgcctgtgtgccagccactcgcccagagtggcccgggctcagaggcagtgctggctgcagcctgctgccaggaaatcagggactctgggggcaggcacttcactgagctgcagaaccaggcgccttctcttggacggtccaggcggaggaccccaggggtgttggggggcgctggctcctgcctcctgtaccccgatcccactggccagcttcctgggaaactgggaaattaaacgtgtgggtgtggagggctctcctggcgggtcgtggaggccctgcactcgcctctctcttccttcctgcccttgccctcttcagactcgtcttcgttgcgtgggtaaatgctccctaggagtcaaatgactgggttacatggcaggcgcatacttagctttagaaggtcccccaaccgtttaagggccagatcgagagctccggtgcccccgcccccgtccccacccgcagtgggtgtcctcgctgccatttcaggcactcgggtgtgtggttttaatttgcatttccagacagctcaaggtgttgaactgtttttcacatgattattggc

SEQ ID NO: 100318 - DNA, 605 bp, Homo sapiens
cggctgatcacgttttattgcaagtccagtgacaagaaacagcatagaaaccataccaattttggtagcactatagatgttctcaataggaaatatttctcctagtccatataggagaaccttggccagggctggaaccagctgggtggtagtgatcagaacattcacacaattctttctggactggatgagaagtaaggactttaatgcagttcctaaccaggaatctgttaaaacttcaatttctgctcttaatctctgcagtgcttccttcctctggggactgaggagaccacccacgttgcttttatgcttatcatagatttctctcactttccggtagcggaaagctagtttcctcatccagtccacacctccctgaacacccacagttgaaccatggctgccactacctcctgagccactgaaaccatctgttgagaaactgtagttgctcaagtcttggccattgtcatcagaagccacatctttcacatgtacctggtcacactcctctaagtcattgaaaaatagatgagtatcagccacttcaaaaatcatttcttccattgttaaacctgagccaatcactactgttgggtcct

SEQ ID NO: 100319 - DNA, 322 bp, Homo sapiens
taagtagctcacagaacgggtgtgagaggccaagtgtgcacaagtgattcagtgattcaggtgattaaaattgtgtattgttaattaatttttttcaggtagaaagttgttttagcaatgattttttaaagaaatcactttttaggaaattaatttatcagaaaaatagaataataattttatttcatctaaagagagtctgaggttttagatgtcatcatctaataatgttaaattttgaaaaagaaaattcaagttattaaaaatcttccaatgactgcaacacttcagtagtaatattaatgtttgagaaaaagcccta

SEQ ID NO: 100320 - DNA, 254 bp, Homo sapiens
gggtgggacttctaggagaaggggtgggagttctggggaggccattagctggttgcaattgagaatgagctcaccatcgctggaggtatacaagaagatggagtggaaggcatcgaggaggtccaggccttgggtaagacaaggaactaggtgcacaagattcctctggactccccttgtccaaaaatggaggtatatcaatttgtgtccatctgaagccaaaatttcagggtgtacctgtaagcgttttaggt

SEQ ID NO: 100321 - DNA, 557 bp, Homo sapiens
gcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctac

SEQ ID NO: 100322 - DNA, 1493 bp, Homo sapiens
gtaagaggttgaggctgcagtgagccaagatgaaaaactccacaccaaaagctaatatacttaatggtgaatgactagttgggacaataggcatgcaccaccatgcccagataattttttttttaatattttgtaaagatggggattccctatattgtccagaatggtcttgaactcctggctttatgcagtctttccacctcagcctcccaaagttctgggttacaggtgtgagccactgcgccgggccaattttggtttttcatggaggacttttagcaggtctcaaaagttttcttctaatagttttcttggtgttctatcattcataggtgttgaatttaccaaactttttctatttcaagtattacatttttactttgttcaagtaatattgtatcatattaaatgaacattgcattgtgaaaataccctgcttagtcatggtatgtaatcatccttatacctttttgtattctttttttaaatatttctgagaatttctgtgtctaaatttaaataggatgttgtttcgtaatcatcttgtgattcttttgtctcctttgggtattattggctaatagatgaattaagaaatgttacctcttctactgcttgaagtttttgtgagaaattgatgtttttcattaagtgttgatgaaatgtacaacttaagcagtttataacagctattctatctaaaaagatataatttttttgttctatggatataagtatattctattatatatataatgaaacaattcataggatgttttttcagtttacttttgtaatccatctctatcggtatttttatttcatagtatgtcatgaacaattattctaggcacttgacatggaataatttgaaaaaatagagaatgagtcccgtactacaatcaataaataactcaaaattttttccatttttaggatgaagaatatgaatatagttctgttacgtaatatttgtgtttactgtgtgagacaaatgagttactgaatgtaaaaataattagtaaaactgccctttgattttggaatgtatgaagcaggcaaatgcccctaccttctatttttatcaatatttagataaggcagacaaataaattttaataagatatacagaataatcttgtatttgaagaatgctatgaaaaaagatagtttggaggagtagttagtatttggctcatataatgtgttaggtaactattctaagccattaaacatttgtatgcttaatacctaagagtttaaagtgaagaaatcaaagattcattgaaaaagaaaaattaaattttaaaaaaattctatttttaattgaaaaataatagttgtatatatctgtctacagtgtaatattttgatatatgtttatgttgtaaaatgattaaatcaagttaatgtttataacctcatataatttttgtggtgaaaacatggaaaatagtctttatagcagttttgaaatacacattgtagtcacc

SEQ ID NO: 100323 - DNA, 1166 bp, Homo sapiens
atctagaggatcccgttcattttctacactatttcaagtattacatttttactttgttcaagtaatattgtatcatattaaatgaacattgcattgtgaaaataccctgcttagtcatggtatgtaatcatccttatacctttttgtattctttttttaaatatttctgagaatttctgtgtctaaatttaaataggatgttgtttcgtaatcatcttgtgattcttttgtctcctttgggtattattggctaatagatgaattaagaaatgttacctcttctactgcttgaagtttttgtgagaaattgatgtttttcattaagtgttgatgaaatgtacaacttaagcagtttataacagctattctatctaaaaagatataatttttttgttctatggatataagtatattctattatatatataatgaaacaattcataggatgttttttcagtttacttttgtaatccatctctatcggtatttttatttcatagtatgtcatgaacaattattctaggcacttgacatggaataatttgaaaaaatagagaatgagtcccgtactacaatcaataaataactcaaaattttttccatttttaggatgaagaatatgaatatagttctgttacgtaatatttgtgtttactgtgtgagacaaatgagttactgaatgtaaaaataattagtaaaactgccctttgattttggaatgtatgaagcaggcaaatgcccctaccttctatttttatcaatatttagataaggcagacaaataaattttaataagatatacagaataatcttgtatttgaagaatgctatgaaaaaagatagtttggaggagtagttagtatttggctcatataatgtgttaggtaactattctaagccattaaacatttgtatgcttaatacctaagagtttaaagtgaagaaatcaaagattcattgaaaaagaaaaattaaattttaaaaaaattctatttttaattgaaaaataatagttgtatatatctgtctacagtgtaatattttgatatatgtttatgttgtaaaatgattaaatcaagttaatgtttataacctcatataatttttgtggtgaaaacatggaaaatagtctttatagcagttttgaaatacacattgtagtcacc

SEQ ID NO: 100324 - DNA, 741 bp, Homo sapiens
tgaagagaaacattacaaatgtaagaaatgtggaaaagtctttaaatccttcacaagcctttctaatccacattataattcatactggaaagaaactctataaatgtgaagaatgtggcaaagcttttaaccacagttcaaaccatgccaaacataagaaaattcacactggacagaaaccccataaatgtgaagaatgtggcaaagcctttaactggttctcatacctaactctacataaaagaattcatactggagagaaaccctacaaatgtgatgaatgtggcaaagcttttaaccagtgttcaaacctcactaaacataagagaattcatactggagagaaaccctacaaatgtgaagaatgtggcaaagcttttaaccggtgctcacaccttactgaacataaaagaattcatactggagagaagccctataaatgtgaagaatgtggtaaagtctttatatcttgttcaagcctttcaaaccataagagaattcatacaagagagaaatgttacaaatctgaagaatgtggcaaaacctttaaccactgctcagacctcaatgtacctgagaaaattcatacctgagaaaaatcctacaaatgtaaaaaatgtggcaaagcctttaatacctgctcatgtcttactcaggaccagagttcatattgaactaaagaattataaatataatgactgtcacaacattcttcagcacggggtaccgagctaaagtcgt

SEQ ID NO: 100325 - DNA, 830 bp, Homo sapiens
tgaagagaaacattacaaatgtaagaaatgtggaaaagtctttaaatccttcacaagcctttctaatccacattataattcatactggaaagaaactctataaatgtgaagaatgtggcaaagcttttaaccacagttcaaaccatgccaaacataagaaaattcacactggacagaaaccccataaatgtgaagaatgtggcaaagcctttaactggttctcatacctaactctacataaaagaattcatactggagagaaaccctacaaatgtgatgaatgtggcaaagcttttaaccagtgttcaaacctcactaaacataagagaattcatactggagagaaaccctacaaatgtgaagaatgtggcaaagcttttaaccggtgctcacaccttactgaacataaaagaattcatactggagagaagccctataaatgtgaagaatgtggtaaagtctttatatcttgttcaagcctttcaaaccataagagaattcatacaagagagaaatgttacaaatctgaagaatgtggcaaaacctttaaccactgctcagacctcaatgtacctgagaaaattcatacctgagaaaaatcctacaaatgtaaaaaatgtggcaaagccttttttcggaagtcagccctggctgaacatttcaggtcacacacaggggggaagccttacgaatgcaaggaatgtggaaatgccttcagcaagaaatcgtatcttgttgtacatcaagaactcacagaggagagaagccaatgaatgtaagaatgtgggaaaccttcttctgtcagtcagccctactgcacactgtcgatc

SEQ ID NO: 100326 - DNA, 3358 bp, Homo sapiens
tgaagagaaacattacaaatgtaagaaatgtggaaaagtctttaaatccttcacaagcctttctaatccacattataattcatactggaaagaaactctataaatgtgaagaatgtggcaaagcttttaaccacagttcaaaccatgccaaacataagaaaattcacactggacagaaaccccataaatgtgaagaatgtggcaaagcctttaactggttctcatacctaactctacataaaagaattcatactggagagaaaccctacaaatgtgatgaatgtggcaaagcttttaaccagtgttcaaacctcactaaacataagagaattcatactggagagaaaccctacaaatgtgaagaatgtggcaaagcttttaaccggtgctcacaccttactgaacataaaagaattcatactggagagaagccctataaatgtgaagaatgtggtaaagtctttatatcttgttcaagcctttcaaaccataagagaattcatacaagagagaaatgttacaaatctgaagaatgtggcaaaacctttaaccactgctcagacctcaatgtacctgagaaaattcatacctgagaaaaatcctacaaatgtaaaaaatgtggcaaagcctttaatacctgctcatgtcttactcaggaccagagttcatattgaactaaagaattataaatataatgactgtcacaacacctttcacagaaaaaaataattttaccacagattaatttgttcattaatggaactttaattctgtggttttttttttttttttttggtctacataaatctgtccttatgccagtactatattgtttaattactgtaacattgtagtaagaatttatatcaggagtgtaagttactgaattttgttatttttcagaattcttgtgtgtttgattttctttatatgtttatatggattttaggaagagcttgtcaatttatattaaagaaaagctacattggaatttgcattgaatctgtagataaatttgttgggtattttgatcttcatattcagtattgctatatttgaatattgagtatatctcagtttattcagctctttgatttctttcagcattttaaataattttcagtgtatagtatgtgcagttattttgttaagttcatttctaatttttttttctaggatactattaatgaaattttaatttaattcttattttgtttattcctataatataaaagtactatctaaccttgtatgttgatcttgtggcattgatgaacttctatattagctcaagtaggtttttatttatttattactttattttattttattttattattatttttttttgagacagagtctcactctgtcacccaggctggagtgcagtggccggatctcggctcactacaagctctgcctcctgggttcacgccattctcctgcctcaacctcccgagtagctgggactacaggcgcctgccactgtgcccggctaattttttgtatttttagtagagacagggtttcaccatattagccaggatggtctcgatctcctgaccttgttatctgcccgcctcgacctcccaaagtgctgggattacaggcgtgagtcaccatgcccagcctcaagtaggtttttaatgaatttcttatacttttaaaatacaacattatggcaataaaagactattccacttcttttctaatctggagattgtattgatttttctagtgtaattttctggctcatacctccagtacaatggtgaatagtggtataagtagaaattctcgtcctgttttcaaacttgcagataaagcccctagtcattcaccattaagtatattagcttttggtgtggagtttttcatcttggctcactgcagcctcaacctcttaagctcaagtgatcctcccaccttaactgcctgagtagttgggacaataggcatgcaccaccatgcccagataattttttttttaatattttgtaaagatggggattccctatattgtccagaatggtcttgaactcctggctttatgcagtctttccacctcagcctcccaaagttctgggttacaggtgtgagccactgcgccgggccaattttggtttttcatggaggacttttagcaggtctcaaaagttttcttctaatagttttcttggtgttctatcattcataggtgttgaatttaccaaactttttctatttcaagtattacatttttactttgttcaagtaatattgtatcatattaaatgaacattgcattgtgaaaataccctgcttagtcatggtatgtaatcatccttatacctttttgtattctttttttaaatatttctgagaatttctgtgtctaaatttaaataggatgttgtttcgtaatcatcttgtgattcttttgtctcctttgggtattattggctaatagatgaattaagaaatgttacctcttctactgcttgaagtttttgtgagaaattgatgtttttcattaagtgttgatgaaatgtacaacttaagcagtttataacagctattctatctaaaaagatataatttttttgttctatggatataagtatattctattatatatataatgaaacaattcataggatgttttttcagtttacttttgtaatccatctctatcggtatttttatttcatagtatgtcatgaacaattattctaggcacttgacatggaataatttgaaaaaatagagaatgagtcccgtactacaatcaataaataactcaaaattttttccatttttaggatgaagaatatgaatatagttctgttacgtaatatttgtgtttactgtgtgagacaaatgagttactgaatgtaaaaataattagtaaaactgccctttgattttggaatgtatgaagcaggcaaatgcccctaccttctatttttatcaatatttagataaggcagacaaataaattttaataagatatacagaataatcttgtatttgaagaatgctatgaaaaaagatagtttggaggagtagttagtatttggctcatataatgtgttaggtaactattctaagccattaaacatttgtatgcttaatacctaagagtttaaagtgaagaaatcaaagattcattgaaaaagaaaaattaaattttaaaaaaattctatttttaattgaaaaataatagttgtatatatctgtctacagtgtaatattttgatatatgtttatgttgtaaaatgattaaatcaagttaatgtttataacctcatataatttttgtggtgaaaacatggaaaatagtctttatagcagttttgaaatacacattgtagtcacc

SEQ ID NO: 100327 - DNA, 3305 bp, Homo sapiens
tgaagagaaacattacaaatgtaagaaatgtggaaaagtctttaaatccttcacaagcctttctaatccacattataattcatactggaaagaaactctataaatgtgaagaatgtggcaaagcttttaaccacagttcaaaccatgccaaacataagaaaattcacactggacagaaaccccataaatgtgaagaatgtggcaaagcctttaactggttctcatacctaactctacataaaagaattcatactggagagaaaccctacaaatgtgatgaatgtggcaaagcttttaaccagtgttcaaacctcactaaacataagagaattcatactggagagaaaccctacaaatgtgaagaatgtggcaaagcttttaaccggtgctcacaccttactgaacataaaagaattcatactggagagaagccctataaatgtgaagaatgtggtaaagtctttatatcttgttcaagcctttcaaaccataagagaattcatacaagagagaaatgttacaaatctgaagaatgtggcaaaacctttaaccactgctcagacctcaatgtacctgagaaaattcatacctgagaaaaatcctacaaatgtaaaaaatgtggcaaagcctttaatacctgctcatgtcttactcaggaccagagttcatattgaactaaagaattataaatataatgactgtcacaacacctttcacagaaaaaaataattttaccacagattaatttgttcattaatggaactttaattctgtggttttttttttttttttttggtctacataaatctgtccttatgccagtactatattgtttaattactgtaacattgtagtaagaatttatatcaggagtgtaagttactgaattttgttatttttcagaattcttgtgtgtttgattttctttatatgtttatatggattttaggaagagcttgtcaatttatattaaagaaaagctacattggaatttgcattgaatctgtagataaatttgttgggtattttgatcttcatattcagtattgctatatttgaatattgagtatatctcagtttattcagctctttgatttctttcagcattttaaataattttcagtgtatagtatgtgcagttattttgttaagttcatttctaatttttttttctaggatactattaatgaaattttaatttaattcttattttgtttattcctataatataaaagtactatctaaccttgtatgttgatcttgtggcattgatgaacttctatattagctcaagtaggtttttatttatttattactttattttattttattttattattatttttttttgagacagagtctcactctgtcacccaggctggagtgcagtggccggatctcggctcactacaagctctgcctcctgggttcacgccattctcctgcctcaacctcccgagtagctgggactacaggcgcctgccactgtgcccggctaattttttgtatttttagtagagacagggtttcaccatattagccaggatggtctcgatctcctgaccttgttatctgcccgcctcgacctcccaaagtgctgggattacaggcgtgagtcaccatgcccagcctcaagtaggtttttaatgaatttcttatacttttaaaatacaacattatggcaatgtaattttctggctcatacctccagtacaatggtgaatagtggtataagtagaaattctcgtcctgttttcaaacttgcagataaagcccctagtcattcaccattaagtatattagcttttggtgtggagtttttcatcttggctcactgcagcctcaacctcttaagctcaagtgatcctcccaccttaactgcctgagtagttgggacaataggcatgcaccaccatgcccagataattttttttttaatattttgtaaagatggggattccctatattgtccagaatggtcttgaactcctggctttatgcagtctttccacctcagcctcccaaagttctgggttacaggtgtgagccactgcgccgggccaattttggtttttcatggaggacttttagcaggtctcaaaagttttcttctaatagttttcttggtgttctatcattcataggtgttgaatttaccaaactttttctatttcaagtattacatttttactttgttcaagtaatattgtatcatattaaatgaacattgcattgtgaaaataccctgcttagtcatggtatgtaatcatccttatacctttttgtattctttttttaaatatttctgagaatttctgtgtctaaatttaaataggatgttgtttcgtaatcatcttgtgattcttttgtctcctttgggtattattggctaatagatgaattaagaaatgttacctcttctactgcttgaagtttttgtgagaaattgatgtttttcattaagtgttgatgaaatgtacaacttaagcagtttataacagctattctatctaaaaagatataatttttttgttctatggatataagtatattctattatatatataatgaaacaattcataggatgttttttcagtttacttttgtaatccatctctatcggtatttttatttcatagtatgtcatgaacaattattctaggcacttgacatggaataatttgaaaaaatagagaatgagtcccgtactacaatcaataaataactcaaaattttttccatttttaggatgaagaatatgaatatagttctgttacgtaatatttgtgtttactgtgtgagacaaatgagttactgaatgtaaaaataattagtaaaactgccctttgattttggaatgtatgaagcaggcaaatgcccctaccttctatttttatcaatatttagataaggcagacaaataaattttaataagatatacagaataatcttgtatttgaagaatgctatgaaaaaagatagtttggaggagtagttagtatttggctcatataatgtgttaggtaactattctaagccattaaacatttgtatgcttaatacctaagagtttaaagtgaagaaatcaaagattcattgaaaaagaaaaattaaattttaaaaaaattctatttttaattgaaaaataatagttgtatatatctgtctacagtgtaatattttgatatatgtttatgttgtaaaatgattaaatcaagttaatgtttataacctcatataatttttgtggtgaaaacatggaaaatagtctttatagcagttttgaaatacacattgtagtcacc

SEQ ID NO: 100328 - DNA, 1723 bp, Homo sapiens
tgaagagaaacattacaaatgtaagaaatgtggaaaagtctttaaatccttcacaagcctttctaatccacattataattcatactggaaagaaactctataaatgtgaagaatgtggcaaagcttttaaccacagttcaaaccatgccaaacataagaaaattcacactggacagaaaccccataaatgtgaagaatgtggcaaagcctttaactggttctcatacctaactctacataaaagaattcatactggagagaaaccctacaaatgtgatgaatgtggcaaagcttttaaccagtgttcaaacctcactaaacataagagaattcatactggagagaaaccctacaaatgtgaagaatgtggcaaagcttttaaccggtgctcacaccttactgaacataaaagaattcatactggagagaagccctataaatgtgaagaatgtggtaaagtctttatatcttgttcaagcctttcaaaccataagagaattcatacaagagagaaatgttacaaatctgaagaatgtggcaaaacctttaaccactgctcagacctcaatgtacctgagaaaattcatacctgagaaaaatcctacaaatgtaaaaaatgtggcaaagcctttaatacctgctcatgtcttactcaggaccagagttcatattgaactaaagaattataaatataatgactgtcacaacacctttcacagaaaaaaataattttaccacagattaatttgttcattaatggaactttaattctgtggttttttttttttttttttggtctacataaatctgtccttatgccagtactatattgtttaattactgtaacattgtagtaagaatttatatcaggagtgtaagttactgaattttgttatttttcagaattcttgtgtgtttgattttctttatatgtttatatggattttaggaagagcttgtcaatttatattaaagaaaagctacattggaatttgcattgaatctgtagataaatttgttgggtattttgatcttcatattcagtattgctatatttgaatattgagtatatctcagtttattcagctctttgatttctttcagcattttaaataattttcagtgtatagtatgtgcagttattttgttaagttcatttctaatttttttttctaggatactattaatgaaattttaatttaattcttattttgtttattcctataatataaaagtactatctaaccttgtatgttgatcttgtggcattgatgaacttctatattagctcaagtaggtttttatttatttattactttattttattttattttattattatttttttttgaataatgcctttaagagttggtggtttgtaagtttctaaactgaaaaccaaacataaatccttgaattcagaaatgcagtgtgtcaaaaagtgaaaaaaaaaattactttaataagctggataacaccaaagagaagaaaaatactaaaaatcagtgtgagaaagaggtaagttgcaaagatgagagcaaaatttctacagcttttataaaacccaaaacataaataggaatggagctaagagaaagtatttattaaagctagaagtagatactcggctaaaatacctttaacaaaaaacggtaaattaaaatatatttttaaaaccctgagtgatttgtttaccaataggagctttttaaaagtgtacttc

SEQ ID NO: 100329 - DNA, 468 bp, Homo sapiens
ttccatagctccctctgctaactcacccccaccccggcttttacacagctcactcctgagccttcttgttctgccaccagagataactgccacagcatatatattctagagtcaatctgctttgggttcaaatccccactgcccggcaggcactttattacaaacaacagcaaacattacagagcactgctctgctccaggcaccttcctggatgcctgtgaaatcactcactcctcacaaccacagcatgaggcaggcactagtatcacacccactttacaaattaatgaagctcacgcaacatgccagaaaacaccaggccagtgagtgtcagagccagaattcaaaactggccatcagctcctgagcccagcctctcagtctctttgcacactgctttgctctacactttactgcccccttaattcccacaagccttgggcaaagtgtaaaccataacagtactg

SEQ ID NO: 100330 - DNA, 342 bp, Homo sapiens
tgacggagtttcgttcttgttgcccaggctagagtgcagtggcacaatcttgactcactgcaacctctgcctcccgggttcaagcaattctcctgcctcagcctcctgagtagctgggattacaggcacctcccaccatgcccagctattttttgtatttttagtagagacagggtttcaccatgttggctaggctggtcttgaactcctgacctcaggtgatcctcctgcctgggcctcccaaagtgctgggattacaggcatgggccactgtgcccggcccacaccttacatttaagagaaaaattacaaaggagaaatgagaatgaagagcagcagaac

SEQ ID NO: 100331 - DNA, 488 bp, Homo sapiens
ttcaacctgctgtttgtatttgattcctgtttatggcatttatgccactcagaagtttccatatagtcaggcttattcatcattttcaaccatggcttctgagttttgtatcacgattaaataattcattccatttttaagattattttaaaaattatttgtcttctgtaagtctcatgatttcattgttttacatttaaatccttgttccattttgaatttatcttctcttatttttccttctcttatttattccaccactatttactgaattacctcttttttgcacagatttcaaatatctttatatacactaaatctccctatgtatttcacaccgttcctcaaactgacacttctcatgttttcccccgttcctcacatactgaatctccccgtgtgtctcaccccattcctcacactgactctccccaggtgtctcaccccattcctcacactgactctcttcatgtgtctcaccccgttct

SEQ ID NO: 100332 - DNA, 408 bp, Homo sapiens
acctgaatacctgttagcctgtatctagagtattcacctgccttcgtcaaggcctcgacaacgagtagactcgttgtcaccaagctgggctgcctggtcaaggacatgaagattaagtccctggagtagatctatctcttctctctgcccatcaaggagtctgtgatcattgactttttcctggggcctctctcaagaaggaggttttgaagacgtgccagtgcagaagcagacctgcaccggccagaacaccaggttcaaggcgtttgttgccatcagggacagtggccacactgatctgggtgttaagtgctccaaggaggtggccactgccatctgcggggccatcatcctggccaagctctccgttgtgcccctacgcattggccttggccttgccatatgcaa

SEQ ID NO: 100333 - DNA, 699 bp, Homo sapiens
aaactgagcacatggctgtaatgactgggcaactgtttaaaagaagataggttccacctcttggaaacacaacctccaactcctcactgcagggcagctgtatcagactttctgattggcggggcctaggaatctgtgttttggttttaggatcagtgcaaattcacatgacataataatccaaacatacagagaggctggcaactcttacccgcctctgacgccttagatgaccactttcatcaacttcttgtatttctggcttgttttctttagggagaccagcaaatacaatacatggtccactcttacctttcccctttcagaaaataaagatgccatatccatgcttcaaaaaagaaaagaaaaaagaaaagaaaagaaagagaagaaaagaaaaaaaaagcagatgggcttcaattcttttctttcaagaaaaattgaaggaaggtccaatcaactaaccatttctgtctgtcacaccttggaaagagtccaaacttcagtgatgacgccacatcagaactctttatattccttgatattgattgattgattgatttacttattttaagatgggtgtcttactctgtcacccaggctggagtatacattggcaagatcacagctcactgtggcctcgacctcctgggctcaagcgcctctccaacctcagcctctcaagtggctaggcacgtg

SEQ ID NO: 100334 - DNA, 604 bp, Homo sapiens
aaaacacacaggaacaccctttacccatcactaagaactcttcacacattcagacaggcgctgcaccctgccatgtgctaggcagaccccgccgtcctctgctgctatgaggcagagaaaggggctcccactcaggctggtgttcacagaaggcttccagccagagaccaggacagctggggtttgaaggaggagcaagactagtcagggaaaagatcccttctgttagagcaggaagggatggagagcaggtggaagcagcatccaagaaaacaggttttgtcagagctacagacagaaaggtctcaagcagctcagggctgcctgattgatctttgaaagcgtcatgccctctagacttaaaatgtcaggcaggtagtagggttattttgacccttgatttcttcatcacacaatacttaatcttcaaagaccctgtggagactttcctttccaacactcagtacttccattttgactggaagtatttttgtgccactcgtataattcacatctattttgagacccatcagtcccttcgaatattcagaatttcccacctcttaatatttctccaacacacaaaaaaacgaactagatgata

SEQ ID NO: 100335 - DNA, 415 bp, Homo sapiens
ctgttcccactcggaccacatccttagaaaatccaggctcggcgcaatggctcacacctgtaatcctagtgcttttagaggcagaggcaggaggattgcttgagccctggagttcgaggctgcaatgagctaggactgcacccctccactccaacctcggcaacaaagagagaccttatctcttacacccccccaaaaaaaagtaagccttgtttgagcccctcatacccaaagagaggcctttttacaactttggctttcaggtactgaattaatactcttaacgaggccagccatggtggttcacacctttaatgccagcattttgggtggccgaggtgggcggatcacctgaggtcaggagttcaagaccagcctggccaacatggtgaaaccccatctctgctaaaaatac

SEQ ID NO: 100336 - DNA, 181 bp, Homo sapiens
ccttccctgactccctgtgataaggtttttgtttcttcccctggattccaaaaaactttatacatctatctagtaagataccatatgggttgaattgtggttccccaaaaggatatgttgaaatcttaacctctagtgccttagcgcaggactttatagagtgtttacagactaatcgagt

SEQ ID NO: 100337 - DNA, 503 bp, Homo sapiens
ggtggttgcaatgtcagttcagttgcaaagccttggctgtgccatctgctccccgccagtgcttgtcagggcctgttgtgtaggacctgagtaattcccagagcctgtcctgtgccttatttgggtttgggcacatttttgcagctcgggggtgagcctgggacttctgttgattcatatacagaattagagcatccctcgtccagctttctccactgtctggtttatcccatgtctccaatttccagggttgttttttctcagctttatgctttctgaaagtcagggttttctctcagagttttagctgttcgtgttgttgtgaaggtccacctgactgggacagttctcagggaaaagttgtgtgaaaagagagaactaccagggacgtccacatcctgtttggactccaggagcccatcttcctgtttcccttgctctcatagaaggtgactacagtgtaccctaatagggctaggagaaacaaaaaggaaaaaaaaaaa

SEQ ID NO: 100338 - DNA, 2179 bp, Homo sapiens
cagaataggtttaagtgcttaaagtgctttttaaaatgtttgcgtctctgggcttacaggtatgagccactgcgcccagccgcatctcttatttttatttatgacttggaacttaagttacttcctaataacatcaagggtaaataatgtagtttccttttattacttacctctttcgtatagagtggttgcatttagtgactaaatctgtagtggtgttttaaaatgatctgatgttagtctgtaaataaaaagattacggttatgttgtttggcatgcttggttaataagtttcaaaagagatcaactaaaaatattttggagcaaatgaaatagaaccttgtacatacagcctagaggaaaccagttcctattcatgtattattaccttctatacgtagctgacttctagggtagaacatgtgtgaaaagtgattgaggaggaggtactgatgccgcttaagatggatggtttgtgggtaggaattgactgagaagaaatactgtctataagtagtaattcagagcttcaaacagcaaaggaccatctctgaatttagtagtcaaagattggtgggggagagaggtgacttcaaagaaaagcctggtgagcttaggggagaggagagatgcttgttgtttttatagattcaataaacacggcaacagagatacaccaaaagtcatcctcgatgtttgcacagtatagcagtgaaggcagctatatgtctacaatttaacatttttcttgagagaaatgtcattcttgaataaatctatttttaaaattgatctgggaatgattcattatgctctagttttctgagtttgagtataaagtttccacttgtctttaatcaaaagaaaacttatttattctttcagagaaaattttcatccatacacagtccattgtgtagatacggggcaagaggagagagaaaatgttagaaaggggctgatgagatcttaagaaacattttaaatctctgttttgcacacgtatttgagaatcgaatatgaggactttttaaaaaaagttttgagaaataatttctttgttaaatcttatattttaatttcttttgaaaactacatttttttgtaaaagcaattatgttattcatgaggaagctagcataaatgagagaaatcgaacttgataagttcttgcattgagtgactgctaatttgaaagtaacagaaagtaacacatgatgagacagatttcctttctggaacacttgttgtttcttagtattgaaaaaaaggactttcattaaaattataatttatccttaaggattagcaatccttttaaaaagagaagagaagaaaaacgtacttgattggtttccctgagttgtgtttttggcaagcccagagctcaaggaaacctgcttggtgacttccccagctggcaattcatttaggactgcaaataagtaacagttgcctcatcatgttagcacttaaagtgaacctggcatttagatctcaaaatctagaggcaaatgaataaggcagggaatctgtccttttctccccatgaaaggtaaagcccttggtaattcaggtgcacactctgataatgtacatgaaaggtcttccttgataaacgataaaccttgtgattttgccacacaagaatttagctaaaccctttcctaatgtcattgtatatgagtagtacagattccatgtgtttgtttccattgaatatacagaaatactgaatacttccttaaaacagcttttattgaaaaaaggaagctgataaaaatcactttgcttttttataaaaacgcttgataggattacctttctagagagacttctgtgtatggccacacttatccaccacagtttttgtttatatagagagcattttaaaaagaagaaggttttcctggccatgcacagtagctcacgcctgtaatcccagcactttgggaggccaaggcggaaggattgcttgaggccaggagtttgagaccagcctaggcaacattgtgagactgtttctataaaaaaaaaaaaactgaaaaatcagccagccatggtcgcccatgcctgtggtcccagctacttgggaggctgaggcaagaaggattcttgagcccaggaggtggaggatgcagtgagccataatcataccactgcattccagccacggca

SEQ ID NO: 100339 - DNA, 460 bp, Homo sapiens
caaaaaaaatttgagggaagagaggctaattaagacattcattatgtttaggtgaaaaacaaaggccagcattctagtattgacagttagaatggaaaggaagctgtagatatggttaatcatggcaacaaagatttatggggagagacacttggaagcagaaattatgagagacttttgaaatagcattattgaggtataatttaaataaatataattcatccgttttaagcgtacagtttgatggattttaacagatgcgtgcaatcctgtaaccactactacaatcatgatacggaacaattgcatcaccccagaaaattccctttacagacagatctgtccctccaaacttagcctctggcatcctctgatctggttcctgtgactctaggcttttctgatgtttgtttgttggccttttctagggtttcctgtaaatggaatctcatgtcttctg

SEQ ID NO: 100340 - DNA, 238 bp, Homo sapiens
ggtatatctgtagaaggaaagacatggagcaatttcttctggtggccaaagtctacatgatacaacaggataggaggctgctcctgcccttactgccagctccagcttgatgcctggggctgctcaaaggtcatgtggccagcccccatgctctgcctggcaagagagaaaggggcagtgcaggcaggcaggccacaccagccacctggactcctgaccttgggctctacctgataca

SEQ ID NO: 100341 - DNA, 358 bp, Homo sapiens
taactggtttcactggctcccatcccttctattttctgggcattaagtctgctcacagcaaggggagctcccagcagggaggtaatctccccgcctcttctcccactgtagccagctgtgcaatatgacaccctgggaaacaatcttttgctgacttaggggactgagggtcaccaggcagcttcctggagcagcaaggcacaagtgaccaccccctcgtccttctgcacttccaaagctccgccctcctcagttcgctgctctctcaatctgaccacgaaggtacgtcaccacttgccaagcaaacaagataagtttcacctggctaccttctccttttaaggagccctagcaagac

SEQ ID NO: 100342 - DNA, 370 bp, Homo sapiens
agccagtgttgctaggtgttccgtgtttgttgcatgcatgcatgaacaggtgaagggctgaaataacccaaggcattcgtatttcccagtggagactgaggccatttccctgggaaataattatcaattgggactaaattaagacaattaaaggattacttactttgtgcttccagagcactttttatatgcttcataatcacttatcttgcagccctgtaattattggctgccagttctatttcttccattagtgtgtgctcagtgtgggtgactgtgtcttatttagctctctattttttgtacctggcattaaggagatcttaggtaagtgtttgtcgaacaaaggaatttgctcagaaaactgagc

SEQ ID NO: 100343 - DNA, 616 bp, Homo sapiens
ctcagtgttttggggaaccagaaacaaaccaataaaataaaggcgtggaaaggctactgtgagaacagaaaggagcaactggggcactgaaacaaaaacaacctgcacagaaattaaattgagccagaacgtaaagaactgaaggaagtgtctgatacagagaagagagaaagtacatttaggccaaaagaatcatcacaggatgaactaaccttctggttccaggagaaagacgagggacttggaaactgaatagtcccatccactgcagctgaaatctgccaccttaacttcctgcagagcttcaatgagaaggagagatcagccaagggcctctgagcacctagtcaactcacagatgtgtgaatgatgataccgaattgctgctttaaacccctcagctttgtggtagttacatgggaatagctaatacaaataagtggtgcagaccccggacacagagctgatacacaggatgtcactgggagaaacagagaaagagtgtggttgtctccccatatctacagtttcacattctgggatttcagttacctgtatttaacggaggatgtctgaaaatattaaataaaaaattcccaaagtaaacaattcgtaa

SEQ ID NO: 100344 - DNA, 231 bp, Homo sapiens
ctccccattcccagctgtatgtaagatggtatctcattttaatagactgttgttatttaaatagactgttgtagtttctaccgcaagatgcaattgttgagagcgtgatttctaacattttacataaaactgccgtaaaaggtttactggaacttaatatacattgcctatttggttgatgctttcaacactctgtagggctttcacacaggactagcctcagtggaattt

SEQ ID NO: 100345 - DNA, 393 bp, Homo sapiens
tgggaccacaggcacacaccactacacccggctaatttttgtatttttttgtagagacggggttttgccatgttgttcaggctgttttgttgcccaggctggtctggaactcctgagctcaagcaatccgcccgccttggcctctcaaagtcctgggattacaggtgtcagccacggcgcccggccaataagagcatcttacacagagctccaaaatcccttgcaacatcctgagtgacaggagtgccttttcttctaatgaagtgactcgctgggctcctggacagcatcaggatgagggctggtcaccaggaagaccaagccaggatttgaagtttagcctcttaagcttgaacttttagcctcccccctcatcctttggggaagagagag

SEQ ID NO: 100346 - DNA, 338 bp, Homo sapiens
tttgggaatgaagaacagccagttctgaaggcatctctgccttctaaggacacacccaagggggccggccgggtggcccctccagcatcctccagtgtgacagcaccccgcaggagtttacttccagcgccaaaatccacttccacacccgctgttctggaggctggaacatccaagatcaagacactggaagaaggaaacaaatgccagtcatcaattctgtaagataactggagaagagtgacatatttatttggcattgcagagccttcacatctttcatctttaacccaccagtcagcaaatttctgttgagaaccactttgggcccacacttt

SEQ ID NO: 100347 - DNA, 393 bp, Homo sapiens
gcggccgcctactactactaaattcgcggccgcgtcgagctaccatgcaatctgccttaccacttgggctgtataacccagcagatccaaaggggctcaaagtatctgtggcagatatagacgaggcatggatcctttgttcagtccctctaggtgaatcactgggtagacctcagaattttaagcacagatatgccatcctcccagatatatacatatttttttgagaaacaggtgttggcttgtcactgggctccattagaaacttaagactctttgggaggccaaggcaggtggatcacctgaggtcaggagtttgagaccagcctggccaacatggccaaaccctgtctctactaaaaatacagaaattagctgggcatggtggtgggc

SEQ ID NO: 100348 - DNA, 239 bp, Homo sapiens
actctagcaggagctctacatccctaaccaggtccagagtgattctcttgcccattaaagtttgagaagcactaacctacatctactgagaaaacaaaatatctggatgtattgagattttgctattctatctgggcctacttaatatgtacacatgtatagggaaaccactttaaaagtacgaaagccctcagtgaggaagaggcaaactagagagacaaagtcaattagtgcttgcg

SEQ ID NO: 100349 - DNA, 344 bp, Homo sapiens
cttggcagcaggggcgggggtggggatgcatcctggtcattggggtcccccaggtcagttcagctggaccagtgcctctcagcaaacaccacctccagaccccaccaggagaagaggcctggctgccacagggagcagggctgggagcatctcagagctgctgggcgaccagccccgcgtcctggcatcctgggcccccttgccttcatcaggcgtggagtggatgcctggctgtgggatgctcaggtggcagtaggccagcagcagaggaagcggggataaggggatggccacaggcttgctccccgctgggcccaagggcaaaggtcaacctctctggacaa

SEQ ID NO: 100350 - DNA, 557 bp, Homo sapiens
agtttctactatgtgctaggaactggggacaccaggggaacttacacgtctgctttgtgtttaagttctcatcacaataaacgtgcacgcagcttgttggctggttgttcactgagtaagcagcacaactgtattttccagcaacttgcctctttagccatgatcttcttccaaaacttactgtacttttaaaattaaagagctctgcatgcaagtagagatgcaatgtgctaacaaatacaatgttactgtattgctgatgataaaagaaagagattatggatgtccaattaacataagcacaggaatcaactggaaaatttctagaaggaaatatagaaaagagtaacacagacaacattcctttctcctaaaactattttagtgactcacagtgctcacgggtcttgaatgttattctaggcacaaaataacaaacaccaagtgacatttttagcagtccattttgcttcaggatatatacacaggaaatgcaaaagcaaaaacaaaagctaaaatgctctaccctaagaggaaagacgcaaccaaactaccat

SEQ ID NO: 100351 - DNA, 224 bp, Homo sapiens
catcagtcatatttcaagtgctcaataactacacgtggctagaggctgttatttcagatggtgcagaacggagcattcccatcattgcagaaaattttattggccagcacttccctagtggacaggttacctttatcactgatggttttgaccagtttacaagaccaaggatcatcatataatgtccctttcgcctactggtaaaaggtggcaaactatttagc

SEQ ID NO: 100352 - DNA, 380 bp, Homo sapiens
ttccacgtgctgattgtgagggactgacgggggtttcaccttctctccttttcctggccccacagccttggctcacgcttcctaggctctgagtttcagttcgtgtcccagcctcccaaccggacagcgttctggaaacagtttatgcatgaactcttgcattttctcttgggaaataatcaaaccctttgtttctaatctcctctcagtctgtactactactactacactaacatgactttggttttggggaaaggaaaggaaaatgtctgttgatgctgggccccaggcagcaccgtgagagctgcaacgggctcacatttgcccctagtttttcctccaggtaggagctgtgggaggagtccagggagtcccttgag

SEQ ID NO: 100353 - DNA, 463 bp, Homo sapiens
gaaccccgtgaaagcacacccttcaggctgcagactattttcctgttttcagctacattctacatgactgtctctgattactaccttgaatcttcaccttggttcgaggtttctgtcacagctaaagggaaaggaaacagggaccttttttcacccagcactgtcttttaaatttatgtcccaaaggaggattaaaaatcctcctaaccatgtaatatacacctgaaattctagctatggtataacaggtgacttctctaacatggctaatgaactgtagcagaagaaaatgtatccctttttacctgagatttcatagtttgtgtatatttcttagtttgtataccagttttttttcaattggtagtataaactcttaaaaattgttgtttgatccaaagactggtatgcttcagatataaacctctaaaggtgttttcatctccttcctccagttaactgg

SEQ ID NO: 100354 - DNA, 466 bp, Homo sapiens
agatgttcaattcctcagtaagattccaggctgcagactattttcctgttttcagctacattctacatgactgtctctgattactaccttgaatcttcaccttggttcgaggtttctgtcacagctaaagggaaaggaaacagggaccttttttcacccagcactgtcttttaaatttatgtcccaaaggaggattaaaaatcctcctaaccatgtaatatacacctgaaattctagctatggtataacaggtgacttctctaacatggctaatgaactgtagcagaagaaaatgtatccctttttacctgagatttcatagtttgtgtatatttcttagtttgtataccagttttttttcaattggtagtataaactcttaaaaattgttgtttgatccaaagactggtatgcttcagatataaacctctaaaggtgttttcatctccttcctccagttaactgg

SEQ ID NO: 100355 - DNA, 540 bp, Homo sapiens
ggcattaaactagacacatagaccagtggaaaagaatacagagtccagaaataaatccaaatatatacgctctggtaatttttcacaatgccaccaagaagacacgatgagaaaaagattgtgtctttaatacatggtgctgagaaagctagatttccatatgtcaaagaataaaatgagactcttgtcttacaccatccatagaaatcaactcaaaatgggtaagacctaaatgtaagaactggaactataacacttttagatgagaacataggggaaaaactcttggacattgttgttaacaacgatatcttggtgtgatgcaccaaaagctcaggccacaaaagaaaacataaataaatgggactacatcaaactaaaaagcttctgtacagcaaaggaaacaacaaaataaaatggcagcctatggattgggaaaaaaagtttgccagccatatatctgataaggtattgatgtccaaaagatataaagaacatatacaacttaatagtagaaaaaataattgaaaaatgagcaga

SEQ ID NO: 100356 - DNA, 183 bp, Homo sapiens
gctatctggactataaaataatctgtttcattagcagagccagaacctgcttagaggtgtcaaggatgctaagaagcagtcatcctgcattatttgcacaatgagcatagacttttggtactggtgtaggaatctggaaagagcagtttattggctagcattctctaaggttcttggtttaca

SEQ ID NO: 100357 - DNA, 257 bp, Homo sapiens
gattaaaccaagaagatacagaatctctgaacaggcagtgagattgaaatggtaattaaaaaaaattccaaacaaaaaaattccaggaccagatagattcatggctgaattctatcagatgttcaaaaaagaactggtaccaattctactatttcaaaggataaggaaatagagaatcatccctaactcattctatgaagccagtatcaccctaataccaaaaccaagggaggacataacaaaaaaaaaagagagag

SEQ ID NO: 100358 - DNA, 299 bp, Homo sapiens
tatactgtgcttaacatttcttttcttgtactactttttgttttcctggattaacctccctcatatttttatttacttggctttcttaaacttgaagcccagcctggcagcatagcaagaccctgtctcaactaaaaatttaaaaaatagccaggtgtggtggcatgcaccagtaataccagctactcaggaggctgaggtgggagggttgcttgagcctgggaggtcaaggctgcagagttgtgatcacgccactgcattccagcttgggctacagagcaagcaagtccctatcttta

SEQ ID NO: 100359 - DNA, 791 bp, Homo sapiens
ctgaagacttttaaggcaaagtctggtgggtgttaagtacagacctgctcacaggcacaggcataggcacctggaatccctggcagccagaggaatctgaatccagtgttttcaaggtggagccgcccccacccaggccttgagtcagaaacctgacttccttccattgatgtttttctctgctctgctcggtacctcacccccatcagtgacagccttcagcacttggtgtccctctatgcacaccttctccctagctctgcctcactctggctgtttgcagggggagggacgtcccctccagcccctggcagccctccgtgtctccctctttggctgtgggtgtctgcttgggtccctctgtccctgcctgttccctgtgccccatctgtcaggttggaggagctgagcagatgcctgggaacagggcgtaacatgcccgtaccttccactgcctctgtgttccttttgaggggttcccagcagggtaccccgtcatgggaaggggtgcacatccctgtacaccaggagcccactctgcactctcagtcccaggctgcatctctgcagcccccaatttcatggtcccagttctggctcaccctcaaataccaccaggttaggttgacagcttcctggagagcacctgcagtgtgagggtcaccccttgaacagccagtaagcaaagcagggtcacttgcttatgttcctctctggcgccctcttctggcccaaggatcaaatggtgcaactcccttaacctgtgtctgagctctgtgtccagaaccctg

SEQ ID NO: 100360 - DNA, 242 bp, Homo sapiens
gcggccgcctactactactaaattcgcggccgcgtcgacacagatgcagatcagggcaaacctggcaaggatatggcttatctgcctgaggaggcccttggaccacaacaccgagaagaagaactgaagcatggggagaataatcagaggtgtcattaagacacagtagcaaactagcatcaaagccagtcaactgaacccaccttataccataatcaaacccccaagggcatcagataaga

SEQ ID NO: 100361 - DNA, 405 bp, Homo sapiens
tgaccttacaggctcaagtgatcctctcacttcagcctcacaagcagctaggacggcaggtgcaccatcacacccggctaatttttaaaaaatattttgtagagactgagtctcatcatcttgcccaggctggtctcaaactcttgggctcaagcgatcctactgcctcgccctcccaaagtgatgggattacaggcatgagccaccactcatgcccatctactttttaaaaactcagtgtatgattttaatatatcttatctgtatgctgctaaagtactaactggtctataagaattaagaatagccaatgatcaactgcaaaaagagtaacaaaacctatcatgcttttactttattccattctttgtttttttctttttctccctatttaaatgtactgag

SEQ ID NO: 100362 - DNA, 280 bp, Homo sapiens
caaactgtttccaggattgagagtctcaaggtgtgatccaagtgcagtagaaatccagccatttgccatattggctactcctccaaacaaggcttagaactcatactcatttgtgaaatgtatttttcacccccttttagagattcatagaaacggcacccccccattccaaatatttatgggtgggttcagttcatgtgccccagagcccacacttcgcttgcaatggtccctacagccccgcaaagacattgctgttgatgctaaggacttggatacc

SEQ ID NO: 100363 - DNA, 242 bp, Homo sapiens
aactaattaaccatagcagtatttatggaatagttggaaagagcaaggactttgaatctgactgtgattgaattccagcactgccacttcacagctgaatgacagctgagagtctcagttcccccatatggacacagatataacaacacacacttcataaagatgttgttgtaatacagaagatggtggataattagtagtggttttcttttctattccttttcttcctgcttagactttat

SEQ ID NO: 100364 - DNA, 309 bp, Homo sapiens
aaccaaaaaaactccttttaagcttaggacacacagttcaacctcatttccctttccccaggaatccagaggtgctcttaaacagttccctgctctaggggactgcgtcagtttctcagctcggagacagacaggagagacatgagagccagcctgggggtctttgctgtccctgcccccgtggagtgtaaatgccaagttgctgatgaattacaaggcaatggatgctcacgcctgtagggaacaactctggggataagaactccctgccgacgcggatcgtattaccccaaccgcagcacgaggcca

SEQ ID NO: 100365 - DNA, 255 bp, Homo sapiens
tgtgtgtgtgtgtgtgtgtgtgtgtttctaaaagttctaacccccagtacttgagaatatgaccttgtttgggcatagggccattgcaaatatagttaaggtgaggttatacagaagcaggatgaggcactaattcaatctgattggtgtttttataagatgtccatctgaagacaaaggcatacagggagaatgccatgtgaaggcagaggactggagggatgcctctacaggccaagaaatgacaaggattgc

SEQ ID NO: 100366 - DNA, 692 bp, Homo sapiens
aacatgcagtatgtggttttctgttcttgcattaggttgcttaggataatagcctctagttccatccatgttgctgaaaaggacatgattttcttgtgtttcatggctgcatagatttccatggtgtctatgtaccacattttttttcattcaattcactgttgctgggcacttagattgattctgtgtccttgctggtgagagtagcactgtaatgaacatattggtgcaggtgtcttttggataaaatgaattcttttcctgtggatatatcccgagtagtgggattgtgggattgaatggtagttctattttaagttcttggagaaatctccaaactgctttccatagtggctgaacaagtttgctttcccactaacaatgtctgtttctttttctctgcagcctcaccaccatctctgactttgtgactggtaagagatggtaactcattgcagttttgatttgcacttatctgatgattaatgatattgagcactttttcatgtttgttggatacttgtatgtcttcttttgaaaagtgtctgctcatgtctttgcccattttttaattgggttttttgttcttgcttgttgaattaagttccttgtagattctggatattggacctttgtcagatgcatagtttgcaaatagtcttccccattctacaggctgtctgtttactgtg

SEQ ID NO: 100367 - DNA, 161 bp, Homo sapiens
ccggacagcctgctctcactgcctcgtgccagccctcagggaactcactgcattaccctgttctgttttgagctctcagctgggctccaagctcccagagcttttctaaatgtagcccacgcttcctttcaggcatccctacccccttcaagccaggccct

SEQ ID NO: 100368 - DNA, 316 bp, Homo sapiens
gcatgatcttggctcactgcaacttccacctcccaggttcaagcgattctcctgcctcagtctcctgagtagctgggactacaggcacccgccaccacgcctggctaatttttgtatttttagtagagacgagtttcaccatgttagccaagctggtcttgaactcctgacctcaggtgatccacccgcctcagcttcccaaagtgctgggattacaggcgtgagccatcgcacccggcagaggcaaagtaaatttctaaacttttagtgtcaggacatggaggtgctgcccactggtctcagccatctatgctcc

SEQ ID NO: 100369 - DNA, 108 bp, Homo sapiens
atatttcctgagggcttgtgatttgccagatcctgtaccaggtgctggaacttggtgatagacaatccacagtctctgctctgaagacatccatgcaggtactaacag

SEQ ID NO: 100370 - DNA, 871 bp, Homo sapiens
  misc_feature (13)..(13): n is a, c, g, or t
  misc_feature (28)..(28): n is a, c, g, or t
  misc_feature (30)..(30): n is a, c, g, or t
  misc_feature (42)..(42): n is a, c, g, or t
  misc_feature (45)..(45): n is a, c, g, or t
  misc_feature (50)..(50): n is a, c, g, or t
  misc_feature (53)..(53): n is a, c, g, or t
ggaactgattacngactccacttatagngngcgaacctccgngangttgncanccggcggtgggcgtaatccgtaatcactaacatttgtcagcatcgcgaatcaattcgcgagactgggagactgctggtaaagatgggaggtggcctttgccgctttccatcttctcactgcagtttcttcacgtgggccacttgtacttaaaatgtcttcttaatttattctttttacttccccagctccaatttgtctacagatttacaaatttgttttatagttttatgactcaatttgtattttcggtcctatgaagctttttgccttaaatatttttctctgtttataagaatgtgctgtttcctaggccagttttgtacacactcttccatagaatagatccagaagaaacacaacaatactgccttcatcatatcaggagatcttgataccaaatacgagtgttgcctccaagatgcaagatcctgagggctccaaagaatccactgtccgtcgcaaatcgacggtccgccagctcagtttcagagacgtggtgctccgctgcaggcctcatcctcaggtgcaccctggcagtcagccatctgaaggtactatggaaattcagttactcactcttgggagcagaaggattccagaccattcctgtgtgcaccctggcagggagccatctgaaggtactgtggaaattcagttactcacccttgcaagcataaggattccagattcttcagggtcccaaacttcagataactctaaaattgctacactatattcttctttatttcatgtgtgccaatttaaatgtacaagtcaatcactagtgctacaaatgcagaagtaaagatgtatttcc

SEQ ID NO: 100371 - DNA, 3770 bp, Homo sapiens
gcgccacctgatcgcctccccctggtacgcctcctccagcggcgctcacgcttcggtaactttgcagcgctcatggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccctgaccttcactgtgttcgccggcggcatcaatcgcaccaagtaccccatcctgtgccaggcggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgttcacacccctgccccttccttgtgatcacacccctgccccttccttgtgatcacacccctgccccttccttgtgttcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtgatctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctatgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtt

SEQ ID NO: 100372 - DNA, 3536 bp, Homo sapiens
cccgtggggggctcatcctacccacagtaagagcatcctggcgtgaccccactgaggacttcacctcctctcccttggtggacacctatccaggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgttcacacccctgccccttccttgtgatcacacccctgccccttccttgtgatcacacccctgccccttccttgtgttcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtgatctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctatgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtt

SEQ ID NO: 100373 - DNA, 174 bp, Homo sapiens
tttttttttctttctgagttgcactgaagggctagccattagatttcaagagagaataaaaacttcatacaaagcacacatagatgagaatcatttctcacttaaggccccaatgctgcccttttgaattcatttaacgcttcagagaaaaaagtctagactttaatgtcattc

SEQ ID NO: 100374 - DNA, 410 bp, Homo sapiens
cccagtaaataatgttaaatggatgtgaccatgccagggagtgggaaagttgttaatctgtttttgaaagccttggattctagctattatcttttagcaataagtacaagtaccaatgatcttttgcccatcattgctactttggtattaatgaactgggcaaatttgtcattatattgagatggttaagtccttggaaagtcagatttgaaatgtaaagacttcatttattgctggagtcaagaggcgcagcattttcaggaagtcaaaaataactttttatgccaggtacggtggctcatgcctgtaatctcaatatcgtgggaggccaaggcaggaggaggattgctttagagcaggagtttgacaccagcctgggtgacatagtaagacctcatctctgaaaaaaa

SEQ ID NO: 100375 - DNA, 360 bp, Homo sapiens
gccctgtcgcccaggtcggagtgccgtggtggcatgtactggtagtcccagttactcgggaggctgaggtaggagggtggattgagccctggaggtccaggctgcagtgaacgaaccatgatcgtgtactgcactccggtctgggtgacagagtctcaaataaaggggggaagttgagagtacaatttggaggaaaccagttaagctgtttaagtatgggattgtgcagtaggggtggagaaaacttaggagagtagagagagatttaggtgttctgttgggaagaattttcttcccaaacttgtctcactttgtttttacagaagatgtactcttatcatctgtaaaaaatatgtatca

SEQ ID NO: 100376 - DNA, 327 bp, Homo sapiens
gagattacaggcgtgagccaccatgcctggcctggatcgcctttttctcatctcggaattagggggttttagaatctttaaggtcccttttatctgtaagatcccagttactcgggaggctgaggtaggagggtggattgagccctggaggtccaggctgcagtgaacgaaccatgatcgtgtactgcactccggtctgggtgacagagtctcaaataaaggggggaagttgaaactacgacagggagagagagagaagtgctgagagggaatgagacaggacccgacgaaaggtgacagcgaccctgcgagggttaaggactcccg

SEQ ID NO: 100377 - DNA, 772 bp, Homo sapiens
gcctgagcaacatggtgaaaccctgtctctacaaaaaatacaaaaaaattagctgggcgtggtggcatgtactggtagtcccagttactcgggaggctgaggtaggagggtggattgagccctggaggtccaggctgcagtgaacgaaccatgatcgtgtactgcactccggtctgggtgacagagtctcaaataaaggggggaagttgagagtacaatttggaggaaaccagttaagctgtttaagtatgggattgtgcagtaggggtggagaaaacttaggagagtagagagagatttaggtgttctgttgggaagaattttcttcccaaacttgtctcactttgtttttacagaagatgtactcttatcatctgtaaaaaatatgtatcagagtatgtgatagacaatatgtatacctgtgttcatgtcatctgaggataagtgctggagcaagaaatcaatatatagtacagtttttaggtcatttggctaaccagctgttaaattgtatgaaagaggcaaagataacattgagcaaaagcaacaggaatttattactggtgtgtcaggaaaaaggttactgaggggtaaggacaaatcaatggaaaatgattacctgggttgtcttatccaactgttccattcagggttataatatttggatccttttaataagattatttgcctatagtgcttatagtgtggagcacccagtaaataatgttaaatggatgtgaccatgccagggagtgggaaagttgttaatctg

SEQ ID NO: 100378 - DNA, 340 bp, Homo sapiens
aatttcaaaactagtagatattggccagccgtggtggctcacacctgtaatcccagcactttgggaggctgaggtgggagggtaacttgagcccaggagttcaagaccagcctgggcaacatggtgagaccccaactacaaaaaagttcaaaaaattagccagatgtggtgacacatgccagtggtcccagcaactgaggaggctgagatgggagaatcacttaagcctagaagtttgaggctgcagtgagctgtgattgtgccctgcactacagaatgggtgatgaagtaagacactatctcaaaaaaataaaaaggacatgttgatggaacacaattc

SEQ ID NO: 100379 - DNA, 249 bp, Homo sapiens
gcggcaggtcggatcacgttgctggccctgtgctggtacccgtttgagaccggattaaggagggaggctttggaggtgccagcggtagtaaacgtgggctctgcacactccgggcgtctcttatcgcgcgggggggcggggggatggggaaagcacgtagcgtcaccggaggctcagaacgcggcagagttgagcgggcgggtgataaatgctgcatagcttttctgtggtagcccctctcgtgccacc

SEQ ID NO: 100380 - DNA, 344 bp, Homo sapiens
tgagacaaagtctcgctcttgcccaggctggagtgcaatgatgtgatctcagctcaatgcaaactccgactcctgagttcaagtgattctcttgcctcagcctccagagtagctgggattacaggcatgtgccaccatgcctggctaatttttgtatttttagtagagatggggtttccctatgttggccaggctggtctcgaactcctgacctcaggtgatctgcccacctcggcctcccagagtgctgggattacaggcatgagccaccatgccctgctcactttatctttttataaataaaacagatacagcaaacaaatcaaatatactgcttaatgagt

SEQ ID NO: 100381 - DNA, 196 bp, Homo sapiens
tcagggcagacggcagagcaccttgagtgcctgctaagggatctggactttatcctggctaggaaaggtccaggctaaggaaagagctgagcaaggagggacaccgtcagaactctggtctcagcatgtcacgatggctactactcaggaaaatgctaatctcttattcaggagccctctcgagagagggaaggag

SEQ ID NO: 100382 - DNA, 399 bp, Homo sapiens
gggacttgcaatgatgaaacagggccattggcaaagctggggtaccagtcacccagccacgctctagggtggtagccaagaagacggaccccgagtgggaggcagagagacaagaggtggatgaagcagagcaagcgtgagcatggtgaagagaagacggagccccgcgctgggagaggaacgcttcagtccgagttccattctgcacccaaggctccccttggtcctcctgggaaccgagggtgccccttagtggtggtggcccaggagaacccgaccaaggcaggagcgccccctcctggaagagcctcgcttcaacgcatcatcattcccggccggcaagcaggggcgacgccagcaaggcctgcgactcagagccagcttggcccgttcgacccg

SEQ ID NO: 100383 - DNA, 810 bp, Homo sapiens
agtcgggggtgggggatggaggcaccatgtccaagaagaggctcaaggggcagaaagtgggggagacatcagggcagggctcacagctgagccacaaggtggacgtgctcactcaggaagcatgtggaagggaaggggcagcccagggaatacgtgtcaggcactttcctggggctgtctcatcataagttccctcggcgtgggaagaactggcttggaaaaacaagagtaaccccaacaggaagccagtgggtaggggcaaagtggtagttcctcacataagtgcaacttcagacttatgggtgccagaggtgggaggtttttagagacgagtgtttttcccttcccttccatgtagatctcagtgaggaacagagaaagcaaaaaactccccagagtcaccccggctgatatgtctttcatacttgaaagagtttatgaaacactggaattatttctgccttgcatattcagaagaacttaccacttaatttttttgcctggaaaataacatttgctactcaatcagctttgttatgaaaccatgggcttctccataggtagctcacaacatggcctccagcttcatcaaagtgagaaagcaagagacagcgagagagagaatgaggcacaagttagtcttttataacgtgatcttaggcataacattagcaagcagatttgcaagacccacggccaccctgcagctgatgcacaccacgtgcaggaactcccatcacccatggccaccctgccaaaatgctttgtcagcaacccctattggagcgttgttgccagtggacccggaac

SEQ ID NO: 100384 - DNA, 237 bp, Homo sapiens
aagacgggtatttggggagttctgcaatggtaaatgagggggaagctaaatgtgtgtggctggtggcataagtaacgtgggatgtgtagattgaggccagaaggcgaagggacttgagtgccattttcaagactttgtttggactttgtctcctagctatggagacctcataaggacctttagtcagggtggtgacttaagagtgggcactattggaatcagaggctcttacaataa

SEQ ID NO: 100385 - DNA, 267 bp, Homo sapiens
gtttcattaggaggggaagagagacgttagaaaagagaaaatgtccatccatcatagccaaactagccaaactctcttacattatctccttcaatcctccgagcaactctgcaaggggcttctagaagcagagctgaggctgggagattaatgctgtcctcaaagtgaagagtcaccactacttgtcaagtcatgtcatctctgcagccacgtgcattttgtaaactgggaagaatgaacagacatttctgacatttttgcttgaga

SEQ ID NO: 100386 - DNA, 283 bp, Homo sapiens
  misc_feature (283)..(283): n is a, c, g, or t
gtttcattaggaggggaagagagacgttagaaaagagaaaatgtccatccatcatagccaaactagccaaactctcttacattatctccttcaatcctccgagcaactctgcaaggggcttctagaagcagagctgaggctgggagattaatgctgtcctcaaagtgaagagtcaccactacttgtcaagtcatgtcatctctgcagccacgtgcattttgtaaactgggaagaatgaacgcctggcctcgttggcctcagcggtggagctctgcggccgaan

SEQ ID NO: 100387 - DNA, 304 bp, Homo sapiens
ggttggttgtgttaatcatgagtcaattattcatggactggaatgcaatatggtcattgaaaataatattgttggagattttttttcacatggaaatttgatacattatgaacaaaggcaacaacgaactgtgtatagttgaatacaattaacattaaaaaagagtcctcttggctttggctgggtgcggtggctcacacctgtaatcccagcactttgggaggctgaggcgggagaatcacgaggtcaggagatggagaccatcctggctaacacggtgaaaccccgtctctaataaaaatac

SEQ ID NO: 100388 - DNA, 384 bp, Homo sapiens
tggttgttgtttgtttgtttgttttttgagacagggtgttgctctgccacccaggctgctacagcttcgatcttccgggctcaagtgatcctcctgcctcagcctcccaagtagctgggactattggcatgcactaccacacccagcttatttttccattttttgtagagatgaagtctcatgatgttgctcaggctggtctcaaactcctgagctcaagcagtcctcccgcctcggcctgctaaagtgctgagattacaggcataagccaccgtgtccagccagaagctgatttttaactcttccttttaaaatttttgctttgacagttctaatcccaccctccacacactgcccccaggcaaatgaatgcttttggtctac

SEQ ID NO: 100389 - DNA, 256 bp, Homo sapiens
caacacagaactctactcccaagagtgacgtctggcagaaactatgaacatgaatgacagtgatgcccaagcagacagacacagtctctgtgagacacatgccaagtgagcatccctcctcccagagatggaccctaaccaccactagacaagagcttcctctgctggaaacagctcatccagccatctccatgatacataccctgcccacagctctgggcatcaggcagataggtgggacaggaggccacaagta

SEQ ID NO: 100390 - DNA, 311 bp, Homo sapiens
caactaaaatcaaataaataaaaaaaaagctgagccagacaaggaatttacctgttttaaccaagtagcccgtttgttaatgttttgtaactgaatctctccaatacccagcatatttatctatatgcagcaagaagtgtcagcaactgcacagattccttattttcttttctgttactacattttcaaataagtagatagtaattctatcatctggcatcccaggaatgtgttaaattaaagcagagggtgctaattctataaaagagaccatgttgggaatgaagtttttggtgtcaccaaaaaaaaaa

SEQ ID NO: 100391 - DNA, 398 bp, Homo sapiens
gtgtttttagcctttccaggttgtggtcggcctcagattcccatccttgctgtgatctggagagatgagccttacccgaggacagatgaacagattatcctcagaagatgaggacatatccaagtagtgaattttactgcagccctctgacactttgtttccatttgtgatttcataggaggttgtctcattgctaagcaactaatgagagctgcctcggctcactccctaatcatctcttaagtaggggagaggctactcctgagggtgcttgcttttctgcctcttacccctcatttgacagataatgaaaatgctcttaatgatcctagaacagtaggacctctgtcagtagacttcagagttgttaattgaaaggagaagttcaactgagatgt

SEQ ID NO: 100392 - DNA, 451 bp, Homo sapiens
gacagcacacttcctcccgccgacgatacctcccgttagctatcgacgcgccttagggaatctcatcaaacaaccagggaaggatcaaccaccagagaaaagaagagactgggagtcatcaccatgtccccaacagaattttcatctatccttctgaggacagctccaagtgattacctagaggactttgcttcataataagtcaaccttcattcctgtgcagccccacctctcaccttcccaaaatgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccagcaattctcccatcctgtgcacatcaaataaattctgtatgcgttttctttta

SEQ ID NO: 100393 - DNA, 519 bp, Homo sapiens
caatggccctaaggagacaagtacatttgcttggaaaactggtcacctaattcccaaaaggacagagctaacattatatgtctcagcatccagtccatcctagatggatttcgattctatctagggaatctcatcaaacaaccagggaaggatcaaccaccagagaaaagaagagactgggagtcatcaccatgtccccaacagaattttcatctatccttctgaggacagctccaagtgattacctagaggactttgcttcataataagtcaaccttcattcctgtgcagccccacctctcaccttcccaaaatgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccagcaattctcccatcctgtgcacatcaaataaattctgtatgcgttttctttta

SEQ ID NO: 100394 - DNA, 894 bp, Homo sapiens
cctgaaagccgctcacctctgaagagtttttcggggccacagtgcctgcatgtgcccccagaggtgcctgtgtaatggacacgaagccaaatggttgtttgcatttgaagatgagaaattcaatcccgcagcacttaaaacaaagtggttggggtgggtgagcagatgagcagaggctgtgagtggaggaactgggaagttacaaaggaagccagagactggctggcttcctccctcaaggacaacggggcaatgtgctggggagagcccaaaacaaaggcggcacatagacagcagacgccagaaaataaacctggagctctgctcagagctccacaacaccagtgttcaggggagccagcaaaaggaactgcagggaggtttttaaaacatgtcaaaatgtggtgtaaatcagcaagtcatgtggaaatgcatgctttttaacctgccagaagctgcagagccggctggatttggctcttctgctccaagaggacaagaagagtttaatacttatcctttaaaacttagggtctggagtgggggcacagtgatcagtggccctctccttgccacctgctgtcaccctggaagaagaggcaatgaaaacagactgttccaaaagatgttttcacccttattgctccactccggctcccacccttccagaaattgagcctcctgaggcacagaagactcagctcagactgcccagcccttacccattccaatgctattgttaccctcaaaatgtcaagcagagaactcaactatgagtccagccacagcagaaatgaaaagagtgtttgcatcaccttaaagagcacctctctccccaccactctgcatgtcaaagcccttgtctgagaattgcaggcagtggtaagaaggaag

SEQ ID NO: 100395 - DNA, 444 bp, Homo sapiens
aggcccttccctgccttcctgacaagcaaataatgggaaagctccttctaagaaactctcccttgttctcttcttgactcctcaaaggtgtgcatacagcaagcagcttcccaaagctagcatgtaacagtcccagcttcccacctgataaaaccactctcccatgcaaggtgaccaattaaccctttttaacctcgaacttttccagtttcagcactgacaatttcatgtcccaggaaactcttcagtactaggcaaagagggacagttagtcaccgtaatcccatggtgccttattcagaccagtcctaaacctatcttaatctccagaagaaataattctattctctgaactgctattttttttttttttttttttttttgagacagagtcttgctctgtcccccaggctggagtgcagtggcacgatcttggctcactgc

SEQ ID NO: 100396 - DNA, 459 bp, Homo sapiens
ttcgctttagggcattaggtagagagaaccatggtttggcttaggattgaaggggccgacagcttcccacctccagttggaaataaatggtggagactctgggaccccagcagggaggaattgtgcagtgggacattaagaggagcttctcggccatggcctgcagtttctccggggagctgagagtaaccctcaagtagctttagggtaggaatggtcttttctaatttcccattcctgtttgcagcctgtttcttccttcagcatttgggcagaacagatgttctggggactctggaaaagaacctgtcctcaaagtcttgctggaccaaaaactgagatattggttgaaactgtccaggaccacattcatgcaggcattgtgtaagatgatcttcaatgagtcttgaaagactgttctgcagctgcttgggggtgtagccaaagggtagacctgaa

SEQ ID NO: 100397 - DNA, 168 bp, Homo sapiens
ggctggtcttgaactcctgacctcaggtgatccacccatctcagctactcaaagtgataatgatgtatttcaaacactggcttttgagaccttgaagactttttctggaagtgggggtatattttccacaatcgctgcacctcctggtggcagtagagggatttgttt

SEQ ID NO: 100398 - DNA, 862 bp, Homo sapiens
ttttttttttgagacgttgtctccccctgtcgcctggctggagtgcaatggtgcgatcttggctcactgcgacctccgcctcccaggttcaagtgattctcctgcctcagcctcccaagtagctgggactacaggcatgaaccaccatgctcagctaactttttgtatttttagtagaaacagggtttcatcatgttggccaggatggtctcgatctcttgaccttgtgattcgcccgcctcagcctcccaaagtgctgggattacaggcatgagccaccatgcccggccaataaaggtattttttttaattagtagattaaattattgctgctgagtcagttagcacacctaaatacttgggtaaaccttcttgaaaggctcctaaaacaactgtaaagtaaaagactactgaacagaaacacacaaaataaacagagaaaaatcctggaaaatattgatcctaaagccctcctcagcaatcccctttgtatttgtgaagatttgccgaaaaataatgtacaaattttacaatgaaagtctgccatacttgacaaaataatttcttgtaatagcaggccgaggaattccattccagttttgagactatactcctagtatgtttcacagaagctgtctgaatgccaatttataaaaataataccctatagagtaagtttgtatctatattttaagtgattcagctctaattaccataaagaaaattcaaaaaattttaaatgttatcaaattgaaccatccttcacttctaaattttgaggaaacacatgtaaaaggaagtaaaaattaaatgctgaaatttgaaaaaatctgaattctatatatgttcataagttcataca

SEQ ID NO: 100399 - DNA, 1335 bp, Homo sapiens
cagtaacatctttaaactgcatagtgttaatttaaagaatcagaacatcatcttttttttttaatatattgcttttcatttcattgccaatgaagttgaataaggatatttattttctgaacatcagaagatttgcagacaaatgatttgagtaaaatctgagcaagttagaaaatgtttatttcttagttttttcagaagaagttttgttttgttttgttttcttttgtttgagacaaggtcttactgtgttgcccaggttggagtgcactgacgcaatctcagctcactgcaacctccgcctcctgggttcaagcgattctcctgtctcagcctcccctagtggctgggattacaggcacctgccaccgcacctggctaagttatctgtagatgacatttcacctgaaggaagttggtggtaacccttacccataaccaaacttaggatttttagatatgggaaaagcaagtatgatgacttacaaagctctgccttaaagggtaatacattggtttaatcaggtttactccacaacagggaattcaggtagcttagttttatatcttctttgagtctaatgacagtcttttgagttgaggagttagtagcattttttttccagccaaaattcccagttgatctttcttcttaattctccagtgttcactagatttgaaattctgccctgcttgcccatggtgctttgtcttatggtagtctcattctccaaaatcatttatcttgaacctcagtgtgacttgtctttccagatctctgcctttgtctgatctctgaaacaccaaagctcttcctttcctttcaaactttccttgtgaccagagtcacaaacgttgctgtgctctgagatggttggttggaaaccagcccaagctgcatttggcacagtatacaccagtgaagacaggttgccaggatgaagccataggctgtctcacagttacagatgaacagcttcctgcccccaggttccccttctactgatgtaactaaggtctctaacccagaactccctaggcaatccactatagcaccattaccgatggttgatggacatgccaaggtattgacctcttaagccagtagtggctggttagagcttggcaaaggagcagccccctcagtttatctcagtgtgccatacaaataatattttctctggatgttacagtgtgaaaaagggtgggaagtagtgccctgttgagccatattagagccccaggcaaaagaaaaaaatgtgcattcctgtatattttttcttctttaatggctaagtttttttccagaatattaaagtagttgaaaaaatagtg

SEQ ID NO: 100400 - DNA, 252 bp, Homo sapiens
aaaatactatacggaagcagccacttgagtttcccaaaatgctgccttcagtaggcacttcactccaattaaccaaagccaatatttacggaaatgttttgctccacatgccttcaaactcaactatgttaaatagctaaccccaggttcccatttacttgacagtccattaggtacaaatatttccagcaccaattactactcttagttgcaaaatcataatctactttatccaggctaagtagaaaagga

SEQ ID NO: 100401 - DNA, 216 bp, Homo sapiens
tcggagtttctggaaactgctctctgtcacatcccacctagctagaatctgactttttctcatcactcggccagggctgccatcagctttcgtctagattactccaactatcctaactgctctccagtttctgctcatggtgcactcctcaggagtcatagtcatccttattttccttcctcttctcaaaaccctccatggttcacatccctcctt

SEQ ID NO: 100402 - DNA, 1150 bp, Homo sapiens
aggaaattaacccatgaaggaaagaaaacttggaaaaataatttaaaaaatgattgttttttaaacataaatcatttttaaattattgattccaagggattgctgataataaatttgttcaggctgtgttaagacttgcatctttttttttttttttttttggaacacggatttccgccactaaacaacccgagggttgtggccgtcaaagggcccctcttttggagcacacatgtgcacaccctccgcacctccgtgggcacccggaggggtacacatcgtgtgaccctagaggagctcgcgtgaagtataccggggaaatggacagggacatgtgatgcacccacaacacggtggccaaaaatagcaggagaatcaaaggcgcaacgacaaccaacgagttgcacacaaagagatgtgatccaccagcgagggatcacacaacaagagccaaccacacactccctccgagagatcagaacacacaaaacccaacaacgcgcgagggcaaacacacacacagagcagaacgaagatggacacaattggaacaacgacgactgagagcgagtcaacaacacagacagaaccacgaggagcccacagctagtaacagcgagaataagcacgacgaaaaaaacgaaacacatccacagagcgaaagacaaaaaacaatcacaacgcgctttcaagaaacaacgaactaaacacacaacgtaggccgctgagtaaagataaaaaagaatcacgacaaccaaagaggaagaagtagaccacacaaagacagggcagaaagcgcgggcatccaagacgcgacacacaaagcgagtcccatccgacaacccccctcaggcaaaaggagggactaaggaggcgacacgtgacacaaccaaccgacacgaagggtgtaccagacaagataacgaaaaacaagagcgaaacaaccaagacaaacgagaacgccgcacgtcacaacacatcagaagagaagaatagcgggagaacaaacatcgcctaaacgcagagaaccgacaacgaaaagtaacaagaacaacaaaacacaccacgagcgacacacaatagcgcaaactacgaggggacacaacacatcgaagaaacaaccacgacgacaaacaaaacacaaagcaga

SEQ ID NO: 100403 - DNA, 552 bp, Homo sapiens
tttatctaaaatatatattattatatgaaattcactttacgaatatttatcaattttgagctgaaatgcagttgcacaatctcggctcactgcaacctccgcctcctggattcaagcgattctcctgcctcagcctctcgagtagctgggactacagaacaagattgtgtcacatgacgatgctcaacaaggttcaatggttaaatgaaggaagaaaacaagaggactttggcataagatgcacagcgaagaagaaatatatatgctgggcttgctgaagaagctgtaaaagcgaaaacagagccccaaaggtaatatactttgctctctgtgaagccctttgacttgaagaaatagtgatctaagataatgtcctgccatccagaagaattgtaggcacgggagagattgaaattggtgtgtaatgttattgcttccttcatttcataactgtaaagcaatgtgctaatcaaagagccagtctgtgtgcacatgcgagctctctgtctgggaggcagacctgatgcagaccagaacccctgctttccaggt

SEQ ID NO: 100404 - DNA, 370 bp, Homo sapiens
gcacacggcagggctgagagcaaaactcagggtcatgtccggattcccaggccggttactgcctctctgaccccagacgtctcatctgtcgaatggggacatttgggaacagcacccactctacgaagccaccatggagacgaaagagccaatcgtctacacgggcagtgtagaacgggcgcctggtgagtgctcagggatgaccctcctcggtagctgccccacagaggccaacaccgcccgcaccgtagccactgcccccaagtccgcctggagggaagagagcaggtcacgctcacctgattctgatgaatcagctggcctgggtcatgcctctcagggagaaaacctttgagtccacagagctgct

SEQ ID NO: 100405 - DNA, 796 bp, Homo sapiens
agtaacctgagttctcttttgttaataatgaaatttgttctcttttcttaataatgaaatcttcccaaatgtttagccagtatttgtgaaaaacatggtttgtgcctcctcccaccactgccattcctgcaagggaacctgccctttgctgaagtagaataggataggttaaatgaatgaggatcattagataggataagttggaataggatgtatctccatccccaatcctttgtggtttttttctcatagtgtatctttgcctgtgcagaggcccgtgatctccattgatgaaccctttgatagatttgattaggaaaaacgtggtggggaatagaacaactggaaaagggatttgagttaaaatgtaaagacctggctttgaccactgcctctccccttattcactgatgaccttacacaagtcatctggcttcacaagagcactagtcacctaacttgttaagcaaaggtaaacatgatactttctgtacagcgttctcaagttttcctaaagagcaagtgaaataatgaatattaaaatgtcatagaaggccaggcgcggtggctcatgcctgtaatcccagcactttgggaggccgaggcgggcggatcacgaggtcaggagatcgagaccatcctggctaacacagtgaaacaccatctctactaaaaatacaggaaaaaaaaaaaggtagccggatgtggtggcaggcgcctgtagtcccagctactcaggaggctgaggtgggagaatggtgtgaacccaggaggcggagcttgcagtgagccgaga

SEQ ID NO: 100406 - DNA, 317 bp, Homo sapiens
cccccacccccccacctcccgccttcctttgtaaatcaagatttttggtttttcaggtatgaaactaggttttccatctagtgccactgattaccagtagctcatgagagctctgtgcttgagtagagttgtaaagccaagtcctgagtttgtatgctggtgttagatcatgctgactgcccggagtgtggtgtggagaaggagacttgacagtgccctcagtttcccctcctgggttacctgatcctcaactctaatttttaatgtcaaaaagaaggaaagatgaaggagggacgaaaagagtgggagagaaggag

SEQ ID NO: 100407 - DNA, 404 bp, Homo sapiens
agacggggtcttgctatgttcgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccagcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtc

SEQ ID NO: 100408 - DNA, 481 bp, Homo sapiens
tgcaagctctgccttccgggttcactctattctcctgcttcagcctcctgagtagctgggactacaggcgcccgccaccacacccggctaattttttgtatttttagtacagatggggtttcaccgtgttagccacgatggtctcgacctcctgacctcgtgatctgcctgcctcagccttccaaagtgctgggattacacagcatgtttcttataattaaaaatgtgatgccagaatttgagcttatgagatgaaggagatgtacttttccctattcctcctggtaagtacaactaaaaaccctggacattatatgtaaaatcaataactaggtaagaagattctgagaggtggagagaaggcagacaggaggctaggaacctcaacacacaagtaacaaaatgataaggagttccaagttaatgttttgcctcacatatgccagagttggaactgaacaagccagcaaactggaaacac

SEQ ID NO: 100409 - DNA, 187 bp, Homo sapiens
tttgggacaggaagtggagaagtagtaaatcgataggttgggactccgtggaatgagggtaaggggcccagagtggatgtagaaagcagagaggggtgaaagatgcttttgaaggaaggtggcttggttggctttgcgttgatttgacatcctgggatggtagtactcatttttctttctttttttt

SEQ ID NO: 100410 - DNA, 363 bp, Homo sapiens
ggggtgtgggtgggtgctaaggtgggtttctccctgaaaacctgtccagctgtcgtagggagggctgctgagagcgtggggccctgatgcactatgaggatcagagtacctcctacatgccctggggcccactgagagcttcatcctcccctgctcactcacgggctctgctccagctcagctgccatccggcttcctgctcacagccttgcatctgtgtccttctctgcaggccaaactgcaccttttctttccttcctatcctcttcagttaatgaaactggaccccagctgcttctcatctcatccccctaaaccaatcctcctggaaaatctcctgtctccagggtagtctgtgcacca

SEQ ID NO: 100411 - DNA, 336 bp, Homo sapiens
gacaaggtttcaccatgttggccaggctgatctcgaacttctggcctcagtgatcccccccaccgccttagcctctcaaagggctgggattataggcttgagctactgcgcccggttacaataagatattttaaagtggggcacagaggctcatggttcaatcccagtactttgggaggccgaggcaggaggattactttaagccagatgtttgagaccagccacaaaattagaccttatctctaaaaagaattttttttttaattagctgagtgtgatggtacatccctgtagtcctagctacttgggagattgaggtgggaggatcacttgagc

SEQ ID NO: 100412 - DNA, 314 bp, Homo sapiens
tcaaattcctgagtccaagtgacacacctgcccctgcctcccaaagtgctaggattacaggtgtgagccactgtgcccagcatatttgatatttcctgatagcagttatcacctattttgttgggtatatttgtcttgacagttagattgtgatctcttttggggcaaacacttttattggtggtgttttgttttttatacagtgtctagcatagtaactgttaaatagtatatagtcaatagatttattatagctaggtagatgggattttaaaagtactaaacaaagttcaattgtagttaattataatgaa

SEQ ID NO: 100413 - DNA, 592 bp, Homo sapiens
gcaaagatactcctattaggcattatgtgtcgaagattacctcccaggagtctaggacaaaggtcagacctctttttggtcaacgttaatttttatttgaaactatacaacattgccatcactctgatatcctttctgttttgtcttcaaaataaccctaattggtgggtaaggatattattataaacaagatctcaagagggaagacgctggggcaaggttgcacagtcgatcctggactcatggtacaagactctttccactctctgagagccctgagtcctgagaagatggaaacaaggaggccaaggcaggtgaattgcttgagtccaggagtttgagaccagcctgagcaacatggtgaaactctgtctctacaaaaaacaaaaaaaatccagcgtggaggcatgcacctgtggtttcagctactcaagaagtgaggcaggaggattgcttgagcctgggaggtcaaggctgcagtgagctgtgattgcatcattatactccagcctgggtgacagagcaaaaccctgccttaaataaataaactgaataaaaggaaacttgtggttaaaaaagaaaaaaaagaaac

SEQ ID NO: 100414 - DNA, 231 bp, Homo sapiens
cttcttccatttttcaccatttcaactttcccccaccccaatcagtaactggtaaaaaagatctgaccatgagttcattattgggaaaatcttacaaaatgctatatttcaagctttttctaaattggatacaactttgcatttccactatgtttttaagtcccctccttaaaaatacacatttatgtacaaataacaatactatattttgcatcttaaaagtagactgcc

SEQ ID NO: 100415 - DNA, 187 bp, Homo sapiens
gatgtgatcgtctagagtacgatggcgtgaatgtgagccaggtaccggtcgacggatagacatgggttggctgcaggctgggcacaggtgggttaggactttctgctcaaagctcttccaatggcgttctctctggctgcaagtaccggggccatttgtggctcaggacaagtgttagtttttgcca

SEQ ID NO: 100416 - DNA, 696 bp, Homo sapiens
gccaaaggatcaccagctcattggcctcttggtagagctctccctctagggtggtacacaaatgctaggggacagttgattttgtggttctgcatgtgagtctctctcctaaacagtgttgtttttgttgtattttttgggtcaattgggattatggttttctttgaaagattgaacccaaaggatccactcatcaactcacaaactaagagcttctgccaggtttttttaaaaattgaaacattctttttcttttcagaaatctacaggtaaaagaaagcttttctaaagaactccctaagttaaactcagcagaaggtatttttaagataattgacttctccttttacagtatcccagtagtggcagtgattaaaatcaacacacaggtctctgtatgtttgctgctgggtagcataagttccaacaacattaattaaacaataacacttgagaggcaggcatttctagggatcaataaccattttgagggacttggtataatacaaaacctaccagacactaatcctctggatgtaccgtgttgccactatcatcatttttatgagaagggaagatacgttaacataattataaaaattgtttagcacatgatgaaattgcagttggtattgccagagtgcttcctaaaaacatacgtcctcagcgcctagcaaagcatcatgggccagctgt

SEQ ID NO: 100417 - DNA, 246 bp, Homo sapiens
gagagtgtgttgggccagagaagccacagtcaagactaagttttctctgggtgacatagaaacctgctggtggggctgagcagaggaatgccatggtcttactacatttgcctttataatgagcagggcctaggacacccttgcccttagtgcctctgcacccctaatgccagggcagagatgagttccctgaaacagatgactgttgatccgtgttgatcaaacaaggctctggatgagaggtca

SEQ ID NO: 100418 - DNA, 277 bp, Homo sapiens
ctacttgggaggctgaggaaggagtatcacttgagcccaggaggtggaggctatagtgaggtatgatggcaccactgtactccagcctgagtgacagagggagccactgtctctaaattaagaaaacaaaaacaaacaaaaaaagaaaagcatatattgggtgggtctggtggctcacacatataatcccaacactttgggaggccataacagggggatcacttgggcccagcagttccagaccagcctgggcagtatagtgagactccgtttgtac

SEQ ID NO: 100419 - DNA, 449 bp, Homo sapiens
cactctctaacgccctcacagttattttatccaagcctaccagcctgtaagtcctgtgagggcaggaatctgtctgcttggctcatccattttccattgcacctagcacaggctagtaaacatgttaaacgaacacatacctccattcctctcctcctaagtcctctgtctaggtaagctttaatggctgactgaggataactttttgaaaagtttccttagactgactaggactcaaccaaagacaggggagccatgaaagctcagggacaccgtagactgagtggtcatagtgattttttccggagggagggacagggctggagtgcagtggcataatcacagctcaccacagccttgacctcccaggctcaagtgatcctctgtcctcagcctcccgagtagccagcactataggtgtgtgccaccataccaggctaattttttta

SEQ ID NO: 100420 - DNA, 625 bp, Homo sapiens
ctgttcctgatttgttccttggcaggactctagagctgaaagctgctgagccttgtgatgcctcactgtcctcattagaaaaactgagctgatagccttcttagtagggttatgagatttaaatattggtgcttgaacaggatagcatctggtatgcaccagatgctaaactcatttctgtctgtcatacatcccagctgctgttgctgtgtaagaggctgtggtgtgagacaacagcagccttctaattttctcacatactctgtggatcaggagagctcacagcagcaggcttagttctgttgctggtacctggggcctcggctggggagacttgaggttcaggaggtggtgactcatgaggggctgcgggagccgtgcctctcacgcacctgccctggtgctggctgtgagggacccctctgggcccgtggctgtggcatctgctgtgagggaccctctgggcccgtggctgtggcatctgctgtgagggaccctctgggccgtggctgtggcatctgctgtgagggaccctctgggctgtggcatctgcaggggcctctccccagggctgcttctcttcctcacagggaagtatctggagctgcagcccaggaggaccagg

SEQ ID NO: 100421 - DNA, 828 bp, Homo sapiens
tgcctggctaatttttatatttttggcagaggcagtgtttcaccatgttggccagggtggcctcaaactcctgacctcaggtgatccacctgcctcagcctcccaaactactgagatttcagatgtgagccactgtgctcggcctaattgtacattttaatataactaaaaatgtaattggattgtttgtaacacaaagaataaatgcttgaggaaatggatacccaatattccgtgatgtgatttttactgattgagtgcctgtacacaatatcttatgtatcccatatttgtgaataaatatgtattcacaaaaattaaaaatatttaaaaaattttaaaattttttaaaagaatatgagatagtctcatatagagggtgaccagtgctgttagagaatgaagtagctactaagataatgttatgcttgccaaaaagtactgatcttgttcaaatgaatgattgtgttagttgaggtaaatgcagtacagagataaattggaattctggctactttatatactagttttataagcttaatgaccgagcctccacttcctaatctataaaaatacattatagtggccacattacagagctgctgtaagcattggataccatgtaaagcccagtgtttactcctgtgcaggcactgaaatattaggtgctatgttgatggtaatgagagcctctgggtcctggagaaccttgggtgaattataaaggactagttgcagagaaaagccaaggtagtgtggccaggaagaaatagctggcaggtaataatcaaattattttatattactgacagaactggagttcataca

SEQ ID NO: 100422 - DNA, 276 bp, Homo sapiens
gacttctccaaaagatccctgatgcattcaatttacatatgtgcttcctctcagccatatcctggtctgaataccagcaatgtcacttactagacagactttgctcatgtgcttttacaagataatacaaacttctgaatgtgtcatgtcctgatcatttaggctaaggatcaatgaactcaaatgtataaggaggccaaagtagctttgtcaaagagcaaagccggctctgtggaaaaaacgacagccttgaggacaatgacaaattgcagtcaa

SEQ ID NO: 100423 - DNA, 433 bp, Homo sapiens
ggctgtgacctgtcttctatccactcaggacactaaaatgtcttagacttacaagagtttacgtaccttttgcattttctctgagcctagtagccttttagacccaggcaacttgagtccttgctctgggactcatgtctgcaggctctgctgcccttgttcttgtgtgcaagtaccaaatatgaggcatgagcagaaatccagggggcctggccccttagcagaagcctgcctttcctcaggagttggacacagcttctcaagaacgcagcatattgtgttgtttctgccaggactcagcgtctggcctgtcatagcagataaaccttgccatgtctaaagggtacccatcttggggcatggataatccagggtgccgcagacaggcaggtcccaggagagagatggtgcccggaggaagggatgggggagc

SEQ ID NO: 100424 - DNA, 286 bp, Homo sapiens
gagcgggcagtgagaaggactttgtttttcagcttgagtgccagccgagccacagtagaatagagcaccaggtatcttcctgaggttcttgactgcaggtcctggttcccagatgccatctttggaatcccccacagccagggagaacctgtcaccctgaagggaaggacacgagcctgcctggattcaccacctgctgactgtagagcccttgggccttgagtaaacataagcagtagtcaggcagtggtcaccatgggccttggtaagacccagtgctgtgctg

SEQ ID NO: 100425 - DNA, 314 bp, Homo sapiens
  misc_feature (2)..(2): n is a, c, g, or t
tncgagctcgctacccctccctgagggctgcagttgctggctgtctttctcggctggtggggaagagctgccagggaagccttcaccccaccccagcacaactccggctctcctctgacagtggcaactttcttcttatataattcttggtgtttccttcaccgttgcacataattttaatgggtaaaagagccaaagcagtctttaaggaaaaactcccacccttggctctacccaaacctcctgcgaggtcacactgcgaggcttcaggtgaagcaaacaggggactttttttccttggctgagaaagcagc

SEQ ID NO: 100426 - DNA, 924 bp, Homo sapiens
atcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacaga

SEQ ID NO: 100427 - DNA, 428 bp, Homo sapiens
ttctcactaatctgttcttcccttctggcgaaaagaatctgagaatgttttaaaatattccctgtgttcccaccaacattctcaatcctaagaaatctccctctgcctcctacgagggaagcaaagttaacacttctaaggagacctttaaaacagaggaagtacaaattgtcataagcttttaggttacctattaaaacgagttttaatgttctagctatttttcctacaaagtacgaagcatttaaagacaaaaataaggtcagtcagccgagcgcagtggctcacgcctgtaatcctaacactttgggaggccgaggtgggtggattgcctgaactcaggagttcgagaccagcctgggcaacacggtgaaaccccatctctactaaaatagaaaaaatcagccgggtgtggtggcgggcgcctg

SEQ ID NO: 100428 - DNA, 1162 bp, Homo sapiens
gggaatgataatcaaatgattcagcctattgttaattttgggtatgcaaaggagaattataacaccatactttggcataaggtagagattaatacataacacggtataaccttcccttcccaacagtattagatgggctgtctacttgggtgatgaatttactcaggatgagggcaggaattcaggtgaaggagaaagactgtaagccaagtgtcaaagtctttaacatctttaataaattaagtcttgaaagactatgcatatgctacgtacaggggagcagatattctagaatgaggatccttctcttttctctatcagctttcagtctaaaaacatgttatacaaatgcagaagtaagcagcctcctaagaaaaatgagtagtgttttccttcattcatcaaactactctttattactgctttgcagacttggcaagaacctctggttcacattttcatccaaaggctcgattttccccactaaagaggaatggagaatgaaattacctgctaattcaagcaagaaaaatatcagctcttattctcataaatttgtgaaaataaattacaactcgattgccccagttctgatttgcaaacatctggtgagaccactaggtatttacaagaacagagtagcatgctatttcctgacaggctgccctttacacaaagaatgttcactttcaacaaactcaaaattactcttactgatggcttcagaatatcactgtctacctcagaaagcggaatgttttgtacaaatcataaataagtggctagacggacactatttggtcatcaaatgatcaatgtagagggcagggggaaattatttctgcagtaccaaccatatatctggtactgtgcaaagggaaaaaggaaatgggctgggaatggtggttcatgcctatcatcccagcactttgggaggcccagctgggaggatcccttgagcctaggagtttaagaccagcctgggcaacattgggagactccatctctacaaaaataaaaaaactggtggcaggagcccgtagtcccagctactcaggaggctgaggcaggagagtggtgtgaacccgggaggcagagcttgcagtgagccaagatcgcaccactgcactccagcctgggtgacagagcaagaatcattctc

SEQ ID NO: 100429 - DNA, 405 bp, Homo sapiens
caaaaaaagagtatagagaccatggaacccccagatgggaagggagagtagagggagcctgaaatgggctttgaggcgggatgccaccacagactgtgtaacttgggcaactgtcttttctgatctgaactcagtctgcacagtgaggtgtgggagaggatatcagagcctgtgatgtcttcccccaggtggaggaagggttcctccagcatggactggagtcagttaacaaatattaaaaagcactcaccgtgtgccaggcagtggggaataagaccaatgagctatgtcacagtgggggaaaacaggcattgaataaataagtcaataagggtcattttaattataaaaattatatagaagtataaataaagtccatacattcctgagtcatgaaaaaaaaaa

SEQ ID NO: 100430 - DNA, 613 bp, Homo sapiens
agataggaatttgactgtttggttatgaatagaggtgtagagtctgaagtagcacctgtactagaaaaggggttgggaattgaataactaaacaatgtggaatactagctgtgtggaatgctgtgcagcagttaagaataagatgaattgataagcactgacatttttggaaagatcttactaaatggaaaaaagctatagaacaatgtgtgtagtatgccatttataaatagattttaagttatatttttctgtgtacatttacatacaaaagcatagtgtctcagaagaaaaggtgtggaaagataatacatcaagtttataagcatctttacctctggaaagcaatgtgggaactgaggaaccatgaaggtagacttttggtttatattctctttgcttctggatagtttaaatttttagccaaagaatatatttatgtgttggttgtacaactaaaaaataagttttattactggaaagggattgggaacagcttgtggggggctgtaatctacaaaagccatcttcagtaccaggtttaattccatcattgtttttcgggttttaggtctctggactattgtcctttaacaacaacaacaacaaaaag

SEQ ID NO: 100431 - DNA, 412 bp, Homo sapiens
ttaacgcctcagggaaggatgagaatactcaggattctgtgctgtaagacttacactgttcagcagtagttaagctgcttcttctggaaaacgtctagaaataattctttcatctatgattgtgaatagtaagtaccacaattatctggtgatctgtttgcatttctatgatatatccacaagtgaaggtacatttgggttgtggggaagaagcacctcccacattccctcaataatagtgaagggatgttgcattgaaaggttcttctgaaggtgctgttttggggaacaggacagcacatttgtatctgtgtgtatttgtgaatgtgtactgtgagcatcactgccagaaaatgattaaagggataaaacaaatgccatttattcctaatccaagctttcttttaatgta

SEQ ID NO: 100432 - DNA, 217 bp, Homo sapiens
aattaaataaaatgttggtatatctgactacataaacattttgcatagtcaaaaacatgataaagtcaaaagacaactgacaaactgggaggaaattttggcagcatgtaccacagtttaagggctaattccctatataaaaagaagtgttaaaaattgaggacaaaggaccagaaacctgataggaaatgagaaaaatacatgaaagacaacccac

SEQ ID NO: 100433 - DNA, 705 bp, Homo sapiens
cctgccatgcgccttcggcgatttctctgagaaacggttgcgttgacagtgggaggcaaggctgaggcggagggacacggagtcgggatcctggagaactgaaatggcgcgttggttactcttgagggagtaaatcagctcactgagtcatcattccaccacaaaaacctgtaaaaagcctgtgctgtggaaaagggctcacttcagaatcaagggcctgggtccacctcgccatttttctgaaggttggaggctctgtccagggacagcggaaattcgaggttcttggcggaggaggagcatttgccaattggggcgggcttttgcccctaccttgagaccttagtgctgtagatgagccaggaaaggtatttgaggggagagtctaggtttctgggaatggagagagtaggacattgtgtgtttccacgcacatcgtttgggggagaaggggttccccgtcgctttgtgcaacatattagtagggtgtagtaggggtagcaaccaagagacccaaaacagtcctgcttaagaagaagccgcttaacggtggattggggaaaaatactctagtgcgctgcattttgaacaggaaggaggtttaacgaaagtgctataaaacctttctgaagaacggggcttcataataagcactaaggtatttagtgtctgtgttgtgcaggacaggtagtgggagctacgaaa

SEQ ID NO: 100434 - DNA, 380 bp, Homo sapiens
aatcctaatgtaaagttaataatagtgtgtccatattggttcatcagttgtaacaaatataccacaccaatgcatgatgttaataatgggggaaactgatgggggtggttgggaatatatgggaactctgtactttttctctcacttctcctgtaagtctaaaattgctctaaaaattaaactctattaatttttttaaattagcaagaaattatatgaaactcaagtttcagtctttacaaataaaattttactagaacacacacacatacacacacacacacacacacacacacacacacacacacacacacaccccacacacacttgcctggtcctgctctccctgggcctccattacacagacacacacagctgta

SEQ ID NO: 100435 - DNA, 404 bp, Homo sapiens
acggtgctaccacgaggaccgcctgcttcatgcacacggcccccctgcagccactgagcgtgcaaaggctggtccacccttcggcccagcctcccctcccgcctgtccagcagaatcagggcacctgattccaggtgaccacaccagtgagaagcgtgcaggagctgggaggagcgggatgcgggtgccgagtgaccgtgggttccaggaattcaacagctcaggatctcctgttcctcccaagaacccaggccacgcagggtaggtggagggcgggaagggtgggtggtgcaggcaagaccagcagctcctgacacaaatgacagctacagctggctgcagggagtgaccccaggtgatcctgtagaggtcacacctcacagccccaaagctgacgttgagga

SEQ ID NO: 100436 - DNA, 611 bp, Homo sapiens
tgttcagagttctgaatcgttgcgagtcagttacaagctgaaccactagcgtctgaaccctatacatctgaagccgggatgaaattcaggagttctattcccccttctccttttaattgtcatggtggtgtctttcgaccctagcagagaatatgtggtcgatattagaatcacctggggagattttacaaagcatctatgcttgggtttctttggagccaataggaaaaaaatgaagaactgtgtacaatggtgactaaagagcctcagcatgacttccgcccctcagcgccatctataacctgttttaccatgtcggatcccgtctggagaagcccaccgagtgcaggtgaaccagggaggcgaagtccatagaaacagctgtcttgggggtccgggaagagtttaacactggaatcacatctgcggaaaccgggaactggaagcaaattgaggatgcggccagaagggaaaatcaagtttttcaagcaatgaggttcggccttggcctaaccaatagtttctaccactctccgcacccctaaaatttccatctattcatctggttccagaaacagattatccagcgtctttgtagatctacgaatatc

SEQ ID NO: 100437 - DNA, 436 bp, Homo sapiens
actctgccacacacattgcagtgcagtggcgcagtcttggttcactgcaccctccctgtcccaggctcaaatcgtcctcccacctcagccttccaagtagccaggaatacaggtatgcactaccatgcccaactaatttttaatttttttttagtagagatgaggtctcaatgaagcagtgttgttgcctggggtaaatacccgggttcatcatctcgagccaagaagattaaggacatgaacacacatgaagatcaagggagaagcagtgatgttttagtatccagaaagtggaaataacccaaatgcccatcaacagcagaatgaaattgtactatattcacaccatggaatattgtatagcaaagagaatgaatgaactattaacagaaaagacatggacaaatctcataaacatgatgctgaaagaaaccac

SEQ ID NO: 100438 - DNA, 331 bp, Homo sapiens
tttagctttcacactgaatatagagtagaaaaaaatagttactttttttgttggatagttggtgatgactggaagtaaattcgaagaattttcttgatggatttacaagtctgatttggcttttccctggttgtgcattcattttcttctaaagtttaaacatgttgaagtggtttttgcctacgtaagctatatatcagaccatgtctgtgtttcaagaaatgacacgtgggccacaggcatggtggctcatacctataatcccagcatgttgcaaggctgaggtgagaagattgcttgagcccaatagtttgagtctgcagtgagccgt

SEQ ID NO: 100439 - DNA, 144 bp, Homo sapiens
taccctttgacctagaaagcccatgtctaggaatcaatcccacacaaaggctggcaaaaatacaaaatgacattggcacaaggtcactcatgcagcaccatttgtaccagcaaaagattgatccaaaacaacccagatgttcct

SEQ ID NO: 100440 - DNA, 374 bp, Homo sapiens
ccttctcttctttgaactctgtggctgagctgtctgggtggtcactgtgtctgattgattcacagatcaaggcaacccctgtaagagccagaaaggtccccagtgaaatccagtggtaataaaacagatgttcctggatcttcttgtgtgtccactagatacctgtgaaaagaatgggcatgtttaaaaacaaaacaaaacaaaacaaaacaaaaaacaaaactcagaaaattggcaaattttagttttagcaattagacttaagctcccttccaaagctacaatgttttagtacaattattaagtagcaaaattgacttatttgaatttcccatccttcctctggctttgaaatattctctactgaatggagt

SEQ ID NO: 100441 - DNA, 342 bp, Homo sapiens
ttattacttttttacaggagagaaaactgacacagagagattaagtaacttgcccaaggtcgcacagctagtgagtggcaggatctggattcaaacccagacagccagctagcctggctgcagggtccatactcctaacccatttgctgggccacctcttatgcacacacacatgcctcttctcatgtgcgtgtcagccgcttcttgtgtcaggggacgaggaagtaggcttatctgtgcacactttctcctgtgttttaaggatcttttgaatgtctgtttccttgtttggggatgtatggtgtgggcgtggcttcacattaggaaacattttctggacat

SEQ ID NO: 100442 - DNA, 361 bp, Homo sapiens
ttttcacttccctctgtttggaacatccttcctctacctttagaattcactgtctctcttcctgcaagactcagctcaaatgtcccctcctccaggaaacatcattttccccactggctatccacagtacattatcatggctcctgttgtttccatgtctctctgccagcttcacagtgagcccttgatggtatggattctgatccccccaagtataatttaacattgtacttctcagtcataggagatagtaggtgcataataaatatgtagtaaatggatgagtatataaacaatgaattaggatctaatgaatgaggatctaatgaatgaatgaggatctaatgaatccagtagttgc

SEQ ID NO: 100443 - DNA, 692 bp, Homo sapiens
aagatttgaacattttaaggttctgcaaagcaacaagaaaaaccaaagctctttttgagattggttccaacaatgttagattaagctaaataaaccagttacaaggtcacaccattaaaagctaaagccaaactgtctcaaacaaggatagaagccctcattttaccacctagtgtgaaaattgtttgaggccaataaagaaaaggaagaagtggtactctcaatactagtgaatgtattgacgttatattggatgggataaagatagcattaatccagattattatcaaatgagtcaggttttatttcagattgatgaatctatacacattagaaaatgctgaattgctgtatgagttatgattcctaaagagaaattcttggaaaaatatcagttctttgtaaagaagtaccaaaacaaattactggggatgaaatattgaaggtggtaaattcatactttgaaacaaataaagtatggaaccaggcttgagtttgtacactgatgggtgactgcaaaaaaaggcataatggcttcacatcaagggtattgtgaagacattgaataggattcaaataattcaatgttttattgacagagaaactcttgtgtaatatacttttcctgtgtaagagttccacactctgatgtgtctaaatggagaatctactgcaactgaggctgcttcact

SEQ ID NO: 100444 - DNA, 494 bp, Homo sapiens
acattcctcccacgtgaagctgcaggccactcgaaggtgagcctggtcccagttttttttcatcagcactgagcacaatgcctgccaccaaggtgccatggaaaagtgtttcttggatggacacataaattagttacttagttaattcattgattcatcatttcattatagccctttggagggagtaagggtaggtgttattgctattttgaggcaggaaaatagggtctggaagcagggaacataagactgattcacacttcagctatgacaggaaatatcctctccatttacatggggcattcaccgagtaaatgactttgttactttacttcatcctctccatttacatagggtgtatgccaaataaccaatggaaacctctagaggatatttaaacccccaaaaaaatctgtcatgggggcccttgaggcccctatgctcaggcccactgccacactgtggagtgtgctttccttttcaataaatctctg

SEQ ID NO: 100445 - DNA, 275 bp, Homo sapiens
agggcaaggttctgctcaagtcgtgtccgccgggcacccacaagcccagttagcagggcccactggcgcaggacgctgtcacgctgggctgccacccgccggatatcgtagtagccttcggctgccaatgcctgggccagctccgccacaccctgcacccgctcctcgtaggccgcaatgtctgcctcgatcgcttcgtgtttcttcatggctgcctccactgcgggcagctcatacctgggagaccagacgctggttctcattcagccagctct

SEQ ID NO: 100446 - DNA, 353 bp, Homo sapiens
gctaattttttatatttttagtagagatggggttttactatgttagccaggatggtctcgatctcctgaccttgtgatccacccgccttggcctcccaaagtgaaacttttctttaaaatagagatgggatcttgctgtattgcccaggctggtctcagactccttgccttaagcagtcctcccacctcagcctcctaaagtgctgggattacaagcgtgaagcattacatccaagtgaaacttcttgagatggttacataatgtctaaatctgctggtgtagaagttaataaagtgtagaactgaataaatattaaatattagatcaagtttctcatgtttatcttaacgta

SEQ ID NO: 100447 - DNA, 541 bp, Homo sapiens
gtgtgtgtgtgtgtgttttacagcaaagacctggatcctgaatcttggggagaaaactccttgcattgtacatattgggctggttacatggctgaagttcaccgtgtcattttaggcctgtttctggcttccacactggtttgcaatgtcatcctagggaagtcagcttgtccttggtaggatatattcattggtgagttcactcaagagactcctttttgcgtttctttaccttcaacgttcgtttcctaaaattgattattccttcataaagttgccagcattttcaacatgcttcctagatgctggatattttattatcgtttgtcacggatcaatttatttttttggcccttaaactatcacattttctgcagttaaatttgcttaactttctaatgcaggggcagaatgtaacctgcaggttgtggctttagaaagcaatgtggaactcggggccatggtaagcaagttggtggtggttttttttaatagcacatctcatcctttgatgtcagaacactgtctacacactctgatt

SEQ ID NO: 100448 - DNA, 193 bp, Homo sapiens
tccagaaccttctcaatcatttattttctgacaagttcagtaaaacttcatcttgaatgataagctccgcaaaggctccacccagactctaaactttgagacagtataagaagtagcttaaaagaaaatgtctctggtgtttttaaaaagtagccatcaagagaccattgctggctgggtgccgtggctcacg

SEQ ID NO: 100449 - DNA, 209 bp, Homo sapiens
agaactgccttgcaatgtctcctcaggggcccaagctgtcttcagcagaacactcaatttccctttaataaagggggtgggggccaggtgcagtggctgacatctgtaatcccagcactttgggaggctgaggcgggcggatcacctgaggtcaggagttcgagaccagcctgaccaacatggtgaaaccccatctctactaaaagtac

SEQ ID NO: 100450 - DNA, 466 bp, Homo sapiens
tcctaccagaaagggagagatggaagttataccagcaggagaaggagaatcaattgtagcatgagatttctaagaaggcaggaggggaggggataagtatacaatatatgtataaatttaattttcagtttgcttggtatatataagtacatatagagattaatagctcccctaataaagagagggagagatggtgtagctgggaccggagtggggagcgagaaggtcggccttaaggggcttatgggttttatgggagcctgcaggaagatgccagtcttgcctcctgtacatgggtatgagagaccaaacaagttctgcttgagaggacttcagtcaaagtggtgccctgaggggacagacaggtttcagtgaaggcaaggctatggagggaatgttggagaagaggttgaggatactaggggtggctggctgctcctggagtaagagcttagccaaattctag

SEQ ID NO: 100451 - DNA, 1073 bp, Homo sapiens
agactctaagtgaaatatagctccctaaatggctgcctgatatgtgagattttgcaattcagatttgagtttttgaatcacagggagctgaaaagggctttaaaattcatctaattcattatttcttatatttgctacttagaagaatcccttgaggccacttaaacaacttccttgtcctacctcatacctgccgaatcaaaataaccaggagataggttttatttttatttttataagttcttcctttgaatctagtgcagccaagttatataatcagccagactcttaggctagaaacaactgattcagcccaaagttttgtataatgcacagcacatctcctgcatgtttgggcatgtaaaacattggcttgcgctgacatccagatcaaccaacttcacaaccatgactcacgctggcaacactatgctacatccaaatggctttaacaagcacatcagtacacacctcttctgacaactacacttgctctactcgacccatggcccaactgcactacccttattggaactactgaaacaccctacacctgtgttaacatagccacttaacctcctacactccggaccaccttactactggcactacgtacgcgctgacacaacgactcgcacgaagtacccctccagctatccacgttcccttctcccaacgctggagtcccctttaccatggctttctctacctcacgacgctggccacagtaatgggacatcacacaccagcttcctactaccctcaaatcttccggcaccacaatttgtcatttgatcttgtaactccccccaccaatatctgctaacactctctctactcaccctacaaatccacaaaacgataccataacagcgtatgaaacgaaaaactagaaagggtaagcagacaaacactagaaacccaccataatccacttttaggccccaaccaaaagaagattaacaccagcacagagcaaaacaggataggccacgaacgaactcccgacaacatacacagtccaatacactcccaaaagatactgcacactagaaacgctaccatatgggccc

SEQ ID NO: 100452 - DNA, 782 bp, Homo sapiens
agcgcagaagggctgggaggtccccaccccaggccccctcatttccagtgaggcctgcagaagacccagaaaatttctcataggccctgaggaggaaaagaacagaaaattagtctgtgtgccaggaatctgggtgccacttaggcgggcctgctggctcagggtctctcacaggctgaaatcaaggtgtcacctgaggctaccatcatctcaaggcttaactggcaaaggatgtacattcagccaccctagatggttgttggcaggacgcaaactcctcgtgggctattgaattgaggacctctgtttattgttcttgtcagcccaaggctgccctgagttccttgccataaggacctctccataaggcagcttgcaacatgggaggtgcttcatcagagccagctggtgacagagtacaagcaagatgaaagtgacagtcttctataacctgatcttggaagtgacagcctatcatttttgccatattcttctcattagaagcaagtcaatagtcccacactctaagtaaggagattgcagaagggcataaataggaggagatggggattgctgaaggccaattcagaagctgcctgcctagaaccaaggagtatacgaagcatgcacaagatggttcatcctggcagaggaggaacagttcttccctcataaccgagctggagaggcacacgtggcagaaggtagaggtgcgaattcacagaaatcaaggatgtaagatgaaggtatgtcttccaacatacggcaacgtccagttgatt

SEQ ID NO: 100453 - DNA, 522 bp, Homo sapiens
atcttagggagccttaaccctactgaattcgtatactccaaggaacttatgggtcgaaaatttctctccaccttaagctatctctgaggtgcgtgagccaccacgccccgcctggagtggctttaaacaacaaaaatctattctctcacagatgcgaagtctagaagtccagaatcaaggtgttagcagagtcctgctcccttggaagcctataggtttccttccttgcctctggtagcttctggtagccccaggcattccttggtttgtggcacagcctaactccagtccctgctgccaccttcacttggccatcttccctctgtgtctgtgcatctctctctgtcttcacatggcattctcttttgataagacatggtgtcactatgtggcccaggcgggaccttgaagtccttggctcaaataatcatctcacctcagcctactgaatagctgggattacaggtgtgtactactccaccggtctgtcatatggaatatgcaggaaccctgcctagctac

SEQ ID NO: 100454 - DNA, 5777 bp, Homo sapiens
  misc_feature (3365)..(3365): n is a, c, g, or t
  misc_feature (3674)..(3674): n is a, c, g, or t
cgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccaaccaccagcactcctgggacctccatagtgaacctgggaacctctgggatcccaccttccctccctgaaactacagccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcattaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccnctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctncaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacccgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggacacagtctctgagcct

SEQ ID NO: 100455 - DNA, 5604 bp, Homo sapiens
  misc_feature (3365)..(3365): n is a, c, g, or t
  misc_feature (3674)..(3674): n is a, c, g, or t
cgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccaaccaccagcactcctgggacctccatagtgaacctgggaacctctgggatcccaccttccctccctgaaactacagccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcattaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggccnctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctncaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgaagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtctagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacccgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggacacagtctctgagcct

SEQ ID NO: 100456 - DNA, 874 bp, Homo sapiens
tcccagttcttcctgcaatctccagtctcaccctctcctcactgatctcctttgtcccaggagctggatcagagataagagaatctctaaggaactgaactcaactttggtctctgtcattttggaaaattactgggaccaagtcagactcttccccaagcagaaaatctgaagctcatagcagaaaaggatttgaaatttgaacccagggccttctcccaaattacttcaccctgtagccacaacagaaaacaggcactagaagcataaaggaccaggaaaggaagagaaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggacacagtctctgagcct

SEQ ID NO: 100457 - DNA, 2998 bp, Homo sapiens
cgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccaaccaccagcactcctgggacctccatagtgaacctgggaacctctgggatcccaccttccctccctgaaactacagccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcattaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagggtgatgcatgttctcctcatatcgcaggttagtgatggtgaagttaattgtgaatagcaccaggagagggctggcggtcatgggtccagacagggagcctggagttctcgaggttgccaggtgcatgtc

SEQ ID NO: 100458 - DNA, 847 bp, Homo sapiens
tgcctgcccacatcaggtagctcttccttactcaatcactgattcaaatgccaatctcttccggaaacaccctcacagacataaccagaaataatgctttctgggtattccttgaccagctatctgggtattccttgacccagttgagtcgacatctaaaatgaatatcacagctatatagaaaagaagcctatttcaagtaacttgaaacataacatttgattgaaattattattatttgagacagggcctcgctctgtcactcaggctggaatgcagtggcccaatcatggctcaagcagcctcaacctcctgggctcaagtgatcctcctgcctcaacctcccaggtagctgggactatagacatgtgccatctcacctggctaattttactttttgtagagatggtgggggtggtctagctatgttgctcaggccggtctcaaacacctggcctcaagcaatcttcctgccttgaccttccaaagtgctgggattacaggagcgagccaccatgcccagctgattgcaattatttactcagtgtaccctaaagacaaaaacaaatagcaaagaagtcttaaattatattcaataatctcatgtttttttctttctttctttttctttgagtcggagtctctttctgtcacccaggctggagtgcagtggtgcgatcttggctcactgcaacctctgcctcctgggttcaactgattctcctgcctcagcctacaaagtagctgggactacaggcacatgccatcacacctggctaatttttgtatttttagtacaggtggggttccaccagtgtttgccagactggtctctaactcctgacct

SEQ ID NO: 100459 - DNA, 739 bp, Homo sapiens
tttttttttttgagatagagtctcactctgtcgcccaggttgaagtgcaatgccacaatctcagctaactgcaacctctgcctcccaggttcaagcgattcttgtgcctcggcctcccaggttgctgggaccacaggtgtgccaccacatccgactaatttttatatttttagtagagagggggtttcaccatgatggccaggctggtctcaaactcctggcctcaagtgatcttcccacctcaccctcccaaagtgctgggattacaggcgtgagccaccacgcctggccaatcctgattctgaaggtgggctgaacatacacttcattcgtgctactcaagtactgctacttcacatatttaatccctctgtgataaagactctcatgcccacctttaagatgatctgaaatttcaaagcaaatcagtaacaattttggcatggcatctaaccaccaattaagaatcacagctcttacaaatgccaaataccacccagagctgaggaagagttcgcagaacaacactattttggttctccactggttaagactttgttctaaattactttcagtgggcatcatattttacattagaactcctaggaggaacagcccagtgaaactcactgtggagttcatggacgatcctggtcttccttactatactgtgccctcttcctgagggctgtaggaaatctcagattccaggaccacgtgtgattctacttcttcagag

SEQ ID NO: 100460 - DNA, 730 bp, Homo sapiens
attttcttgttgagcactgattgggacacagtgttctcttcaagatggtttccaattattttaatagtactgctgaagatttaagtatatggataatcaaatgtgcctatcagtgtattcagtgacagagaaaaagacatgtttgatgtctctgtgaagtgagccctactttctgaggatgaggagtttagtcctttgctggaattctgatgttcaattataaatcctatgattgatttctatataccaaaagatcttcttataaccaacgacatacagtgttagtggttcttctcattttgctatttctataaccactgtaactctgaatcttattttaatctagaaaagatactgtattcttccctaaaccccaggttaaatcagacagggttggacttctcctcattgcatggcatcatcggaatgaatcaccctaacaaagcgacatgcttgtgtccctctgtggaaaattgcatttcatgcattgtgagaaaaaaactacatccagatttcatgtgagtgtttatcttgcagaaattcttggatacagttctgcttcatgattcattttccactctttattcatgttgagtcctctctagtgctggaatcatagcgaccagaggccatctctcttcaaatgtaaaaagtggttgattttcaaacagatgataaatgtgaaatcatctaaactactaagtaataaaaattaactggtagtttatca

SEQ ID NO: 100461 - DNA, 545 bp, Homo sapiens
cgagctcggtacccctcaacgctgtatacttgcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtataaagcgttgaggggtcctctagagtcaccgcgca

SEQ ID NO: 100462 - DNA, 4268 bp, Homo sapiens
agcggggctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtgggagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccgttctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacgtcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcggctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaatacc

SEQ ID NO: 100463 - DNA, 3290 bp, Homo sapiens
cggacgcgtgggtcgacccacgcgtcggacccacgcgtcgagaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccgttctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacgtcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcggctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaatacc

SEQ ID NO: 100464 - DNA, 4333 bp, Homo sapiens
agcggggctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtgggagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccgttctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacgtcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcggctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaataccaaaagacaccaaaaaagacaaatacactaaaaacgggggggccccctccacaagtttcccccagg

SEQ ID NO: 100465 - DNA, 3755 bp, Homo sapiens
agcggggctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtgggagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccgttctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacgtcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcggctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacgtaccaaccattatccagaggcaccatggagagttagtcatggatagctgtgtattgggtacgagctcg

SEQ ID NO: 100466 - DNA, 3797 bp, Homo sapiens
agcggggctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtgggagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccgttctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacgtcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcggctcactgcaagctccacctcccgggttcacgccatcctcctgcctcagcctcctgagtagctgggactacaggtgcctgccaccacacccagctaattttttttgtatttttagtagagacggggtttcaccgtgttagccaggatggtcttgatctcctgacctcgtgatccacccgcctcagcctcccaaagtgctgggattgcaggcatgagccactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgacttttctctcattttattcttccataatgtatttctactataaaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtccgcagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgacgccccggatgacacacagcatgccgcacagtataggaccggc

SEQ ID NO: 100467 - DNA, 1214 bp, Homo sapiens
taggaataataacttcatcactagaattcttcacctggttgttgtgaagttaatcagaataaatgtggagataatacatgaatgagcgtacagaatattatttggctgttctgtggcatcgatataggtcatgatagtgacaatagtgtctgtcattgtattccacaccacttcttccctcagctaaagcaggaaaagaaaggaggtaagtctctctgtgttttttcttcctttccccaagcccactttgttaccttccttggttgctggatgagaaattagtcagagggtcagagaggacctcaacttcatatgctttaaatagagcatatgcaattttaaaccatcctcttaaccaatttttcttttcttttcagtttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaatacc

SEQ ID NO: 100468 - DNA, 2726 bp, Homo sapiens
agcggggctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtgggagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccgttctcagaacacctctgagtaacgtgtttgccagtagctattctcactgatgcactgatggccctgaagaagcggatccagtcacataggaaaggaggctgtgttagtgaaagcacatggaaggtgttgctttagaaaggtagtcaggaaaaacattcaggaatagatttatacaccattattgttttatttttaaattttcattcactcttctgtttggatacttttgctaattaacgtcctatgttaatttccaccaagctataagtccatagtcagtaaaacattccccttgggctgtcatgagctaaaagcagtgtcatctccgcatgttggagcagccaagaaatagtttggtactaccgacattgtctaatccatgtcacatcctcatacaatttaattgctcaaccatgcatttaaaactcctcaagaaaggattggtactgcaactgtaggtaaactgaaaaaaaataagaaagaaagagttggatgaaaatgtgaaagcccaagtttagatgtgcattaagtattaaatagcacagtatcttcttcatggagccttttttcctcccccatcccctgcagctgcctttttttgggggcagggtgggggttgatgttgaactttaagagtttaaaagtttagcttattgagtagttgtcatttaaaatataattgcgaatatcagaaaactcatactggaaaactaaattttttttttctcttgagacggagtctcgctctgttgcccaggctggagtgcagtggcgcgatctcggctcactgcaagctccacctcccgggttcacgccatcctcctgcctcagcctcctgtagtcccagccactgaggaggctgagtcaggaggatcatttgagcccaggaggttgaggctgcagtgagctgtgattacaccactgacgccagctgggtgactgagcaagacctgtctcaaaaagaagatcaatgcctcccctgacgagtggggcg

SEQ ID NO: 100469 - DNA, 1395 bp, Homo sapiens
agcggggctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtgggagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaagtttcgctgttgttgcccaggctggagtgcaatggcacgatctcagctcactgcaaccttcacctcccggattcaagcgatgtttctgcctcagcctcccaagtagctgggattacaggcacccgccaccacacctggctaattttttgtatttttagtagagatggggtttcaccatgttggccaggctggtctcgaactcctaacctcaggtgatccacccgccttggcctcccaccacgcctgggattacaggtgtgagccaccacgcccagcctgttagtgtaacttttctaacagaagttcagcgggagatcctgttgcccagcactgttcatcttacattaaagcaagatgtggtgaagttcaagtac

SEQ ID NO: 100470 - DNA, 1200 bp, Homo sapiens
agcggggctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtgggagggccggggccggggacgccagcggcacgcggaagaagaagggcccggggcccctggccacggcgtacctggtcatctacaatgtggtgatgacagccgggtggctggttatagcggttggtctggtccgagcatacctggctaagggtagctaccatagcctttattattcaattgaaaagcctttgaaattctttcaaactggagccttattggagattttacattgtgctataggaattgttccatcttctgttgtcctgacttctttccaggtgatgtcaagagtttttctaatatgggcagtaacacatagcgtcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaagttaaatcagacagggttggacttctcctcattgcatggcatcatcggaatgaatcaccctaacaaagcgacatgcttgtgtccctctgtggaaaattgcatttcatgcattgtgagaaaaaaactacatccagatttcatgtgagtgtttatcttgcagaaattcttggatacagttctgcttcatgattcattttccactctttattcatgttgagtcctctctagtgctggaatcatagcgaccagaggccatctctcttcaaatgtaaaaagtggttgattttcaaacagatgataaatgtgaaatcatctaaactactaagtaataaaaattaactggtagtttatca

SEQ ID NO: 100471 - DNA, 407 bp, Homo sapiens
tagaccaaaataatgtcaacactaacaaacactagtcaacttttctgattcacatgtttgttatggctaaagagttccaggtcagagttccaggtcatgtcaatatagctgagataaagctcacattcactgtaggaactgggttaatagtgggaaacatatcccagatatgcagtgttgttaaaaagaagactgattaaatggtaaagtcctgtaatctgagttctcatggaggttcagatggtgtggatgtggtctgcaactcagttatatttttctgatatcttgttcgtatcatgttgcccaggccgctctcgaactcctgagctcaagcaatctgcctgcctcactctccccaaattctaggatttcaggcatgagccaccacacctgacccaagtcatcat

SEQ ID NO: 100472 - DNA, 762 bp, Homo sapiens
agtctaggataaatcagtttttgaaattatgtaggctactagatgcatttattattttgttcaccaagaggtactatggaagattgccttttcattttacctaattcatattgcagttctcctggaaccatgtgaacatatcatttaaaattttgcatttcaagagttaatccttcccatgttggtaaaatgcttataatatatacattgggttagccaatgatttgtttttttttttctcatgtttagaaaaaaacaaaagataatgagccaagatttattaagatttattaagtgttttctatgtcaggaattaggttaaacactttatatatcttattctttattttgaaaaatttatatacctcaagcatacatcaaaatatagaagataaaactaatacctgtgtacctaccacccaattgtgtcagttcttaactttttgccatatttgtttcagattttgttatgtttcatgttttatttttgttaagaaattaaatatcgcagaaataaatgaatctctgtatgcacttatttcctcacctgtttccttctgtcccttcccagtggtaattactatccttaacttagtgtttttcaatactattcatgctttaatactttatatgattatacctgaaattactttatagtgccatttgtcacatttttaaactaataagtgatgatagcatgctgtatgtatcctgcaaaagctattatgtgctcaacattatttttaatatttgaaatatatt

SEQ ID NO: 100473 - DNA, 351 bp, Homo sapiens
cttttccatcttagctaagcgcttatgcactgtggctgtaacttttgcggcttgagggatgatggcaaaactagcacaaaattctttttccttcttcacagtttcaaggatagaagattcattcttaccatagatcttgcaacctcagcatatgacttttccttccttcctcaagaaactttccaccaaaaggaagccctgtatggcttctctttggcttatctgcattgccagcatcattgcttgcactacggggcaatcatgaagcagaatacaactgcttgatcacaagaaccgtgataccacaatagttgatctgatcatggagctggctacgtagtgactaacggg

SEQ ID NO: 100474 - DNA, 533 bp, Homo sapiens
cttgtctacacttacatgtttgtatactcttatggtgtaaaaccctggcctcttctgtctccatgaacatgccatcccttggctcacagtctgcagaaaactaatgatagaaagccaaggtcctggccttaatctgtgagaatcagtcatcctgctgtgcttcatggtcacagactttatccttcatgcaggatctgagcacagatcagcatattcagtggtcattacggtgagtctctgcttaaagaccaaataggggaaagtatggataaaacagcacaaatcgaagagcaccatgaagtaactttcagtgttttaaatataatgatgaaataaaaatgagatatcatttttaatatcttgacaaattataaaatgcttctcccacctcttcatccttcctcttcttcattcttcattgacattggcatatatacttgttcccatgaaatgagttagtggagacaaatgctaatttattaaacacttgcatgccatattgatggtaagtgtcattggcagaactggatatc

SEQ ID NO: 100475 - DNA, 262 bp, Homo sapiens
ttcagaatcgcttaagcaccactttaggtgaactctatctgttttgattaacttttatctttcattatatattttataattttcattatttcttttaaagagatgtttttaaaaacatttttaaaatttctgtgtacacacacacacacacttgggttctgtaactgtccattgggtcaagtttttctccttcaaccgtgccttatgacactttattgaaatgtaccaattcaataaaatacactatggtagtaggtgatca

SEQ ID NO: 100476 - DNA, 807 bp, Homo sapiens
ctttgacccaaagacaacttgcttacaggaatgccttatcaccaccttccaggaagcctactttgtttcagaaagttttgaagaagccaaagaaaagatgaggtacagattggcaatatggcccgtacaagcactgtttggggtgctgttgttacagaaacacaactgatgtctcctaggggtggtaagacaacaggataagtgcaaagagaaataagagcatcaggttgatgcttaagggacttcactggtaataccaatccagaagcagttgctgtagtacaatgatggaatggcctactgaagactcattgtatgacagcattgctcactcttgggtccatgcggcttgtatgaactgtaacacttgccgcgaagatctgcaggttcactcctgagcccagcgagatcacgagcccagccgggaggaacgcagcaagatccagacgcgctgcttaagagcgtgtaacagtcacagcgaaggtctgctagcttcactcctgagcgccagggagaccagaggcaccaggaggaacgagacaatgccagacgcgcggcttaagagctgtaacactcaccgcagaggtgctggagctgtccactcctggagccaggcgagacctacgaacccaccagaaggaagaaacttccgaaaagaaatctgaacatcagaaggggcagactctcgaggcgccactgaaagagctgtataaaactcaaccgagaaggcgcggcgggttcatcctgacagcagtgcgaccagaacccgcggatccgacacaatggatggaaaaaaaaatccctggg

SEQ ID NO: 100477 - DNA, 753 bp, Homo sapiens
ctttgacccaaagacaacttgcttacaggaatgccttatcaccaccttccaggaagcctactttgtttcagaaagttttgaagaagccaaagaaaagatgagatgggatttttctacttacccatatgcatgatggaatatggtgactttataacttctgaggtacagattggcaatatggcccgtacaagcactgtttggggtgctgttgttacagaaacacaactgatgtctcctaggggtggtaagacaacaggataagtgaattctttatctaacaggtaataactcaaatgcttcgtcaaaggctggttttccaggcctgttggagacagaccacttggataagaaacagtcaagagactttatcatctgtttctcccatgtccaactgctgtggaatgaactgggtgcctccagaattcccaactgaagccctaacttgcagtgtgactgtatttggaaataggacctgcaggaagtaattaagcctaagtgaggtcataagggtagggcgctaatccgataagtctggtgccttatgagaagaggaagagacaccagagctgtctttctaccatgtgaggacacagcgaggcttgttggtgttgattacatggctctaggaactgtctgagaatcaaggaatttctacaactgttctcgaaaaagctgtcatcttttgtagcctcaagactaatttagatggaaatcagatggaaagcctgatgctgcagtttgttgaattataag

SEQ ID NO: 100478 - DNA, 595 bp, Homo sapiens
ctttgacccaaagacaacttgcttacaggaatgccttatcaccaccttccaggaagcctactttgtttcagaaagttttgaagaagccaaagaaaagatgaggtacagattggcaatatggcccgtacaagcactgtttggggtgctgttgttacagaaacacaactgatgtctcctaggggtggtaagacaacaggataagtgaagagaaactgaggcacaagtgttatgtggtcaagatcatacagctaataggtggcagtctgactccaagtgtgtgcttttcactgctgtgatatgccaataaagcatctacttatcagttggctttgaacttggaatagaaaaggagcatgattatattactctaaaacctcagtctcaaactcgaaaagccattaaaaaagaaaacaataaataaaacttctatcaaggctcaagacttctctcatcattgaaggtcatggtaaatcttttactttccatctcccaacctttatactgatattccttgtttggcacttacttattgccatgtgtatttatagatttggttgtatgatgtagtctcctttagagtgtgaacttgttgaag

SEQ ID NO: 100479 - DNA, 469 bp, Homo sapiens
ttggccaggctggtctcaaactcctgaccttaggtgatccatgtgcctcagcctcccaaagtgttgggattacaggcatgagccaccatgcctggccaatcatgccatattatcccctctatcagtatagaatatggacactgtttctattttggtgattaccctagaccaggggtccccagtccctggggctgcagaccagtactggtctgtggcctcacagcaggcagcaagcagcaggagagtgagcattaccacctgagctctgcctcctgtaagatcagtggcggcatttgattctaataggagcacaaaccctattgtgaactatgcatgcgagggatctaggttgtgtgctccttatgagactaatacctgatgatctgagatggaacagtttcatctgcaaaccatccccacacccccaccccagtccatggaaaaattgtcttctatgaaactggtccct

SEQ ID NO: 100480 - DNA, 455 bp, Homo sapiens
caaggagcctgggagccacttcggcagaagcagagcttggacgttggtgatgggagcccagtgaccccagccagcctttctggctgagcgactgcactggcatgaaaccaagatggggttcggctcctgaggtttcctccttcctgcccctgattgcttttcccacctcactgtctttcccctactcccaccagtctgctgtatggggctcctgcccttgcccacttcttacctttccatttgtctccttcccttcatcgacccgaagcatcttcctcatcctccttggagagatggtttgctggttcacgtgtatctctcactccaaaactatggccaaaatcctgtgtaattatttacttagtaaagatatttgttcctgctctctcagtttttatagcagtgatgtgaatcatttctatttcctcactttaaaggaaaatgcttttattatt

SEQ ID NO: 100481 - DNA, 535 bp, Homo sapiens
atcttcaaccagggcagagccaccacgactgggatctgaaacatcatggccacagcacagcatcttcaaccagggcagagccaccacgactgggatcggaaacatcacggccacagcacagcatctccaacaagggccgagccagtgtcttgagggagaggagagaaatgctgtgtgcgttttggtggtagtgctggtccgaggacaaaattccaggaagtccatttacggatcctgtaggtcagacccttcacatccagacagccctggctggacgggaggagacccagcctgaaggccagagcactctgctgggaccaggctcatcggagctacggaagggacttacagcaaagcaaaagtccaaagacaaaagctctttttggccaaacgtggttggagaagcatgagacagccccttggtctacggccccttggtctacgactcctacagctccagaactggcatttctaggagattcctttgcccatttcttcaccaacccccaggaaccaagggccaggcagtgtcctc

SEQ ID NO: 100482 - DNA, 200 bp, Homo sapiens
tcagatgaagtgaaaataattatacaatctgaaaaatgctttataataagacatttatgatctttcacagataagataaaaaggaaaaacattcataatgaagactaagaaaatataaaacaaaaccatgcaaaaatgatatgataacaggcagatctaaaaatagcttattaaacaattagagaaaccgtcgcataaac

SEQ ID NO: 100483 - DNA, 301 bp, Homo sapiens
gtttcctcctctgaaaacttatactgttcttgggagttctgagttgtctggtgtatctgtttcttttgctgggtgcttcaccttggcttcctcccaaatgcctccagcaactgtttatttttataaatgttgtatacacagggcagaagatagagaaaggggtgagccagagtcatttacgaaagcactttggcattctgctctggaaatcatttccgcaggaggctgccctggacagagtgcacttactctcagacctcccatccccacttccaagcagaagtcaatgcaatttttattt

SEQ ID NO: 100484 - DNA, 1749 bp, Homo sapiens
tgggaagatcatttgagcctgggaagttgagccttcattgagctgtgattgtgccactgcacttcagcctgggtgacagagggaggccttgtctcaaaaaaacaaaaacaaacacatgtttacggatggtttaggtttcttcaaatatcttaaggtggttggttttcctaaagaggtttctttaatggtgatagactgtcactgtgctatgactttaagctagattgcagtagttacttttttaaaaagaaatgtttttaaagtaaaacttgagtttgcattaatagtttggctctaacaacctaatattttcaaattaggaaaaatttgaagctctcacaagtaattcagcattaaatatgagaatgtactaaagcatagggtggattgaggcactgtatgttatgctactactaaggtagtagcaaaataagctcttatgggtgttatctgctgccaggatggccagattgaatcagaaacaaagtcaagatttcagctggtcaacctgttttatttaggacaatgtttggcaaattggagagtgtgacctgtaagtgggttgtaaaattaatttagtggatcacgaccagtgttaagaaaactgtaatagaagagaatagaaaagatgacagtatgttacatgcagtaacggtaattacttgtttgttgcagttgttgtatgtattggttcatggtgtgaaatgtatttcttaactacatggtgtttactatgagcacttagcacagctcatagaacattcaagataataggcagtcaatgaatgttcaactgcactaaatttaatttaaacttatataggaaaaaattgcacaagtaatttcagaaaagttttctaacacaaaatggcattaggaaaattggtagaactttaactgttgtgctggaattatcttgttatatgcctgtgaccttcttgggtctgtggggacttagctttatatcagtgtgcatgatggaagagcctgatttttagagtcagaaagaactgcgttccaattttgtctcttgacccatataaacttctggacattgggcaatttttttcagcactctgagcttcaaattcctcatttaaaaaagacgacataatagcacttacctaacgattaagagagggatcaattctaaacatctaatactttgcctggaacatagtagatgcttaataaacagttaattaaaagggtatgaaacataattgaatactagtatatattttaaaacactgttttgagtatccaggaaaaagtatgaagtgtaagagtaattaaatcacatgcatgggtagaaattccttgtgaccttttgaaaaattgaaaaaaagcataattgtaaaagattgcttccttttttaaaaaaaaaattgcccagttagcataatatgcaagatgtaaactagaaattaaatgagccaaaaccagagttagttgcttgtaaagattaaaagtgaactcacactgggtgtggtggctcacacctgtagtcctagcactttgggaggatgaggcttgagccaggagtttgagaacagcctggacaaaatagtgagactttatctctacttaaaaaaaaaaaaaaaaaaattagccggggtggtggtgtgtgcctatagtcctagctactctggaggctgaggtagggggattgctggagcctaggagtttgagcttgcagtgagctacgatcttgcttgtacttcagcctgggtgacagagcaagacttt

SEQ ID NO: 100485 - DNA, 1026 bp, Homo sapiens
ctcattggtggaaggaacttgccttgtctcagctgtcatgtaagacatgctgccttgcttccccttcaccttccaccatgattctaagtttcctgaggtctctccagccatgcagaacttttcaaacccctggaatcatctgattggttcgcttaaaagtccaccttcgtccaattggttttctcaaagaggacagatttgcacatggcaaacgtgactcatgaacaaattctctatgtgtccccatgaatgaaaggccagttgctagagaaagaaaatcatatattgggcagatgcctaaaagttgttacctgatgactgtgagagagaggagaagcagtaaacttttagtggaaaatgaataaataaaaggacatcaggacgagatgcaaaggaaagatgagaagatgatgactttgaatcagaatggcagagagatttgaagtcaacaatcacagaagaatcatccataatttagtgggtaatctctctactcttggtctcaagtggacattgagtaagtattaccagatacatatatgtttcagatgtgtagatttatagtatatacttgcatcaggattaggcagtatgagattcaacctatgaatattttcccacttctgttacttcttctacatttataaatcaagagtaacacaaaaattcatttcataatacattattttgatattctttcatcatttgaatgaaaagcagcttatatttaaaagggagagaagaaaaaaaaccaactaaccttgagtttctgctgaagtagctgaggatccaagatgctctaggctgcaagctgaagtttgaagaaaattcagcctgctgacttttatcctctcttttggacaagatgactgtgggcaatttgggcctctggctatgaaacatgaacctgtctatccgcgttattaatggatacttgatgggatgagctaacaatgactttggtttctttgaaaaaaggaaatttcttgagataggaaaagccaaataaacagaaatacggtgaca

SEQ ID NO: 100486 - DNA, 1059 bp, Homo sapiens
  misc_feature (4)..(4): n is a, c, g, or t
  misc_feature (233)..(237): n is a, c, g, or t
aaantcttaactataaacgggggggccttctttttttttacaccccccccaccccctttggggagggacttcctttttttccctcctttttaaaaaaggcctttttcccctccccctccccaaaaaatataaaaaccggggggtttccccccccccaaaattttttaaaccccggaaattttttttttttttttttaaaaaaccccccctctctccccgccggggtttttttnnnnnaacacagctgcggctcatgaacaaattctctatgtgtccccatgaatgaaaggccagttgctagagaaagaaaatcatatattgggcagatgcctaaaagttgttacctgatgactgtgagagagaggagaagcagtaaacttttagtggaaaatgaataaataaaaggacatcaggacgagatgcaaaggaaagatgagaagatgatgactttgaatcagaatggcagagagatttgaagtcaacaatcacagaagaatcatccataatttagtgggtaatctctctactcttggtctcaagtggacattgagtaagtattaccagatacatatatgtttcagatgtgtagatttatagtatatacttgcatcaggattaggcagtatgagattcaacctatgaatattttcccacttctgttacttcttctacatttataaatcaagagtaacacaaaaattcatttcataatacattattttgatattctttcatcatttgaatgaaaagcagcttatatttaaaagggagagaagaaaaaaaaccaactaaccttgagtttctgctgaagtagctgaggatccaagatgctctaggctgcaagctgaagtttgaagaaaattcagcctgctgacttttatcctctcttttggacaagatgactgtgggcaatttgggcctctggctatgaaacatgaacctgtctatccgcgttattaatggatacttgatgggatgagctaacaatgactttggtttctttgaaaaaaggaaatttcttgagataggaaaagccaaataaacagaaatacggtgaca

SEQ ID NO: 100487 - DNA, 1026 bp, Homo sapiens
ctgaaggcttgccctggctattctgccgttgacatgggcctcaccctaccacggggataggtcttggatggagggaagagggagactcaccgggggcctcctgagtcctttgagtgtccccatgaccccagcacctgggacagctgctggaaagagggtactggcaaaaatttgctaaatggacaatcataggcccagtgtggtggctcacgtctgtaatcccagcactttgggaggccgaggtgtgcagatcactgaagtccaggagtttgagaccagcctgggcaacatggtgaaaccccatttctacagaaaactacaaaaattagctggacacggtagcacacacctatagttcctgctactcaggaggctaaggtgggaggatcgcttgagcccaggagatcaaggctatggtgagccgtgatcgtgccactgtactccagcctggatgacagaggaagaccctgtctcaaaacaaacaaaacaacagcaacaacaagaaaacaataatagggacattgagtaccctttctggcacctggcactctgccaaatgctatgcacactccgcccttcagtcttcccaggaaccctgtgcagtttgtagcgtggctcacatttgccaagaaggaagtgaggctcagcgaggttaagcagtgcctgtggagtcacatggctgcaagtagtggcctggactggactgcagagcccatgctccccaccgctttccatggggcaactctaggccatcattctccacccctcagacccaaagctgccttttcataatgcttgctgttgctccctttatgctcctgaaatgaaatttatggctaatatgccagcctttacatctaattaaaaatcatccaatggtttttttgtccttattaatatataagaaataaaaggtaatgataatgtgtttgtgaagtgcccagttgctggggaggtcacagctctgtgtacagactgatgctcgggtgtggtggtgtcaacgtctgaaacgatgaatttggtaaa

SEQ ID NO: 100488 - DNA, 948 bp, Homo sapiens
ctgaaggcttgccctggctattctgccgttgacatgggcctcaccctaccacggggataggtcttggatggagggaagagggagactcaccgggggcctcctgagtcctttgagtgtccccatgaccccagcacctgggacagctgctggaaagagggtactggcaaaaatttgctaaatggacaatcataggcccagtgtggtggctcacgtctgtaatcccagcactttgggaggccgaggtgtgcagatcactgaagtccaggagtttgagaccagcctgggcaacatggtgaaaccccatttctacagaaaactacaaaaattagctggacacggtagcacacacctatagttcctgctactcaggaggctaaggtgggaggatcgcttgagcccaggagatcaaggctatggtgagccgtgatcgtgccactgtactccagcctggatgacagaggaagaccctgtctcaaaacaaacaaaacaacagcaacaacaagaaaacaataatagggacattgagtaccctttctggcacctggcactctgccaaatgctatgcacactccgcccttcagtcttcccaggaaccctgtgcagtttgtagcgtggctcacatttgccaagaaggaagtgaggctcagcgaggttaagcagtgcctgtggagtcacatggctgcaagtagtggcctggactggactgcagagcccatgctccccaccgctttccatggggccagaattttgcccactgccttggccgagatttgaagaccatcagccatattgagtttctgtgggttgtattcctgtttcttcaaggggtgtatgtcagtgactgtttgcacaggtagcttatttatgtgcagcattgctgggagtgcatgagcatgtttaatgcctgccatccacggaatatcggggtgtgttgcagtgtgctttcct

SEQ ID NO: 100489 - DNA, 684 bp, Homo sapiens
tgtcagaactggccacattttttacccaacaattgctaacaagattagtgtcattttaaaaaaaatcttagtactcatcatactaaaaacatgcttgacccttgcagccctttctttacctcctaatgcaaagggagccttaaatgcccacatgaaaggaaagcaaagctcttgagttttactcactaaactgtaagctccttaagggccgaaatgtatcttagtcatataaatatctgggcactcagttgatgtttgtggatagatggacagatgttgaaagaggcaggtattcgtactcctgttttagatatgaaaaatgtaagcaaaaaggattaattaccatggctgtggtatgaaacttgtttaaagttggcatttaaattcaagtctgcaacattaaagttctgtgtacagagccgttttcccactgtagcagcagcgcagcagcagcgctgctatgattgattaagcacttgctatgtgccagagttaataattgtgataatatattaactcatttaattttcaggaaactaagacatggaaaggttaggtaacttgcccaaggtcgcacagctagtaagtggcagacatccagagtctctgctctgctcttaactctcaccatactacctctgtatccatttcataaataaagatagtagtttcttataacagtaa

SEQ ID NO: 100490 - DNA, 357 bp, Homo sapiens
ccttcttgctgcatcatcccatggcagaggatagaaaggcaggagagcacgcccaaggcagagtaggaaggaggccaaaaccatcctttataaggaagccactcctgctgtagtgaacccactcccaaaaaaatggcattaatccatccatgatggcagagtctccatgacctaatcaccttttaacagtcccaattctcaacactgttgcacccggaattaaatttccaacacaaaacctttaggggacacattcaaatcatagcaatagtattatgactgttttacagagatggaacctgaagcccagagaggttacccagcttgctcaaggttatgattctaatacacagtgga

SEQ ID NO: 100491 - DNA, 941 bp, Homo sapiens
taatggatttggtaatgatggaagcaattttggaggtggtggaagctacaaggattttggcaattacaacaatcagtcttcaaattttggacccatgaagggaggaaattttggaggcagaagctctggccccctatggcggtggaggccagtactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtgaagaagccattgtcttcggaaaccttggtgtagttgaactgatagttactgttgtgacctgaagttcaccattaaaagggattatccaagcaaaatcatggaattattggttataaaagtgattgttggtacatcctatgcaatatatctaaattgaataatggtaccagataaaattatagatgggaatgaagcttgtgtatcatccattatcgtatgtaatcaataaacgatttaattctcttga

SEQ ID NO: 100492 - DNA, 388 bp, Homo sapiens
agcctaggacacaggttttagagcaaaatttactagctgaattacttgatataagtgatttagcctccctgagtctcaatttctcacctaataaaatggaaatgacatcacccacttcactaggattccgtgtgaattaaatgagatgatgtaggcaaaacacctggtttatggtaggtacttaataatgttagctaccttccctgaatccctaatgctggcccataatttgtcctcaaaacagataagccattcatggataaataggagttgaccatagtactatttacgattacttgtgcttctgctgcaaaatacaggagtgagctaagattgtactgaacgcattcattttctttttaattttttttttttgagatagggtctc

SEQ ID NO: 100493 - DNA, 777 bp, Homo sapiens
catgatttttcagcaattctggggcattgatatgaaacactagataagtaggtggcaatggctctgaaaatattcttgaggtgcaaattgaacaattaattgaagaacttagagaaacactgactagagaaaatcaaggggctggctatggtggctcacacctgtaatcccagcactttgagaggcggaggtgggcagattgcttgagcccaggagttcaaaaccagcttgggcaacatggcgaaaccctgtctgtacaaaaaatagaaaaattaaccaggtgtgctggcatgcgcctgtggtcccagctacttgggaggctgaggtgggagaatggcttgagcccatgaggcaaaggttggagtgagctgagccgagattgcaccactgcactccagcctgggcgacagagccagatcctatctgaacaagaagatccacaagagaagtaacgtgaaatcacctgttttcgggcgactcggggacttccgaagaggtttctcacacaccattacgcttggtgcgtcagggcgccccagtgtggtacggtcgaccctgggctcaaggcggtgttcacgagagaaagccgcgggtcaatccgccaacagcgcgtgaggattcccacacccattaaaaacacaccgccgcgggggagcaaccacacggctttccggaaaacaaaccccacgacgggcgttctccaggggcccataagggggcaccatcacaacagggcagctcccagagggaaagcgcggactaccaaatgtagccccg

SEQ ID NO: 100494 - DNA, 756 bp, Homo sapiens
ggaacagaaaatggagccattgcttacgcgaatcgtttgagggaaggggcgggagttggggaggtggagttccctgttaaaacgggccacttgattagcaaagtggtagctgttattttgggggaattcccgtcttgattgcattaaggcgggtctccatctttccaggccaggaggaatgtggtggtggaggtggaggattgtggtatgtggtcaggagtgagaagaaatagtaaggccgtcccggtgagggagaaatgtaacctaaaacctgtctctgctgttgttggattgggtcacccctggtctatggcatgaaagttttattgggaggagatctgctgcaagagtctgattgcttgggtcagtgcaacaggacagaatctagtcgctgcatacctccttccctgtcctcaatcaggatcacagtctatccatacacagggaccaggccaacaccagactgccaatgaccctacattgggacaccacagatcccccagacaagcagctgctgtgatcatgggcaatatctaaggcaaccttctacaagagcctgatcggcgcaaacaggagactgcgcatcctgactgggttgggacatgggatgccggaagggaaagaaccaaagatccttatacaatgctgaaactgggggaagaatcgtcaacacacaatgcattaccaattgggttcacatggtggatacaggtggagtataataaacattagattttaaaggtgtggggaatgtgg

SEQ ID NO: 100495 - DNA, 779 bp, Homo sapiens
gggaatcaggactcagagaacagacactaatactctggttactgtgatttctctgaataataaactgtcctttatctttgacccagaagtctttgtcttctgtcagcatccatggaactgtggctcaagcagggtaaaatctcagagtcttcatagttcttgacaggaagcaggaaagtatgatgcacaggaaaagaaaagttgataaatggaactcaacccataaatgatgcagatgatagaattaatatgaaagggcatgttaaaagttgttataactctgttccacatatttacaaaattaaaattaggactgaccatgttaattcgagacaaagaagttatagaaagacccaaattgaatttcaaggaattcaaaacacagtgcctgaattaaaaattatacttgatgagaacagtggcagattagatactatagaagaaaagattaatgaacttgaagatgaagcaatagaagctatccaaatgaaaacagaataagtgactgaggggaaaaaaaaagagcatccatgagctatgagacatcttgaagggtggttctaattacaatataaatgaatgtgaatctctgagggtgaatgtgggagaaagggacagaaaaaatatttgaagtaaaactgattaaaatgtttcaatgtgatgaaattatcaacccacatatgcaagaagttctatgaccccaaagcataagaaacataatgaaaattacacctaagtacatcataatcaatttattcaacaccagcaataaagagaaa

SEQ ID NO: 100496 - DNA, 224 bp, Homo sapiens
tgggttttgagggtcacaatggccaggccctcccctatggccataccaagcaacccagggcaggggtcacattttatatccaagtactagggacacacgaaccaaggcatggccttttcttacaatttaaaaaattgagatgcaattcatataaaattcatcattttattatacaatgtagtgttttttagtacattgaccgtgttgtgcaacccttaccccaa

SEQ ID NO: 100497 - DNA, 192 bp, Homo sapiens
taacctcatttcacaagcgaggaaaacagggccatccaaggaggctgaaaggcacgcccagaatcccaccactagctgtgagcagcacagctgcggcactcgctgggtcctaggcctgcagaatgagcatctacgtctgtcttcctatgattcatgctcaagtctctcttcacacttgcagcaccaatgaaa

SEQ ID NO: 100498 - DNA, 201 bp, Homo sapiens
tctgcatcccccatccccttgagaagggctttggtataacaggagttcaggaatatcagacattcagagtaagtcaccaggataaggcaaatcatgccttggagaatatcacccacatctgtatagagttacagagaagggtccccatgcgtctcattgactgtatatgggaccaactggtggctggctggttgtcatggc

SEQ ID NO: 100499 - DNA, 692 bp, Homo sapiens
gatcttggctcactgcaacctctgattcccgggttcaagcgattctcctgtctcagcctcccgagtagctgggattacaggcgcccaccaccatgcctgtctaatttttgtacttttagtatagacagagtttcaccatgttggccaggctggcctcgatctcctcacctcaggtcatccactgccttggactcccaaagtgctgggattacagctgatggttttataaaggggagtttccctacacaagctcttttgcctgctgccatgtaagagatgtgactttgttcctcacctgccttctgccatgagtgtgaggcctctccgaccatgtgcaactgtgagtcaattaaacctctttttttataaattacccagcctcagatatgtctttattagcagcgtgagaacagactaatacaacctgtatgccagaaaggctgggagcacctgtggactctgacaggctgtacagaaagcatagcactggcttctgcttctggtgaagcctctgacaactgacaatcaaggtgaaaaataaatccggtgcttgcacatcacatgccgcaatactgacatgacagcagggcgcttggtacacagcttccactgacctggatttggattggtttggcctctataatgaagtttgatgtctctgctttactgacaaggtattaatgtggttgttt

SEQ ID NO: 100500 - DNA, 4256 bp, Homo sapiens
gagtccagctgccgtcgccgccgccagcggacggggcggggatcctggtgccaggtcttcgttaacccgcccccgcctgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaagaattcttataataattctcaagcaccatcgcctggcttgggaagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtag

SEQ ID NO: 100501 - DNA, 747 bp, Homo sapiens
gagtccagctgccgtcgccgccgccagcggacggggcggggatcctggtgccaggtcttcgttaacccgcccccgcctgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggaggtaagaagggccgacagactgacccagggccgggccgggccgcgggggttgtggccggggccgggtgggggtgggggcccgcaagttctgcggggagcctcggggagaccctccgggctggggctgctcaatcaggcgtcacccctcctctcatctgcgcgtcccaccccaccaccttcccgcaaagataagaaaataaaaaaagctaacccaatcctaacaaaaattcccagaaatccatccgtttagtgtttctcctttcctctttctttcctcagacgttccatcggctgatttgttactttttcatatcctcctcaatttcaaattatgtctaattaaagagaaaataggcccagattctggctaacattacccagctagttctcgctt

SEQ ID NO: 100502 - DNA, 499 bp, Homo sapiens
agatggagtctcgccctgttgccaggctggagtgcagtggcgcgatctcggctcactgcaacctccgcctcccagggttcaagtgattctcctgcctcagcctcccgagtagctgggactacaggtgcacgccaccacgcccaactaatttttgtatttttcgtagagacggggtttcaccatgttggccaggatggtcttgatctcctgacctcatgatccgccagcctcggcctcccaaaaaagtggtatacttctaatggataaaggttatacagctatcttcacctggtacactgtcttcggtattacctttagttttaaatgaagtgttttcttaagaccaagaattttaaattgaaattagttattttataaagggctctaaataaggatatgactacaatggatgctgctgaaagaattgaatgataaagattattaggtggcttaatgctttttgtattaatctctgggaaagtccattattgatcccaaa

SEQ ID NO: 100503 - DNA, 733 bp, Homo sapiens
gagtccagctgccgtcgccgccgccagcggacggggcggggatcctggtgccaggtcttcgttaacccgcccccgcctgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttgg

SEQ ID NO: 100504 - DNA, 4774 bp, Homo sapiens
agtgttgcagattccctggtaatccctagtgccagagtttgccagcctttactaccattgtctgtttaatcaaaatccttgctgctataaattggctgtatttctcttggtttgttctagtgaaaataagacaaactgtcctgattatagagatgggacttccattttcccctcactccaaagacttcctttttcaatacaagtttagttgctgttactaatccaagttaatttttgattctatcactgaaaacctgggttttgccatttattgaggtgttaattgaaatattaatatatttagagcagaaatgtcgttttttagggaatctagagcaacagcaaagctgaggtcaaactaccgtaaggatggacaccaaggaagctgtgtttgggacaaaaagaaatcaagataaggtagatgcaaagtagagaaaagaactggaccctggggggaagggtggtagttgggagtgggttatatgcttctaagggcaaagaataggcagatttctgaagaggagggcccaaaaggaaatactgaggatttgtgttcaaatactacgttccctctgaatgtacaagtttttgcttttagctaacagagtacttcaaacattgataaggttaagtgttttgttggggtgggttctaatattctgggctagtgtttccttggaatagttgtggaagacactattggtatttgttgataaaaccattaccaaaacccagcttcagcactaatgcctgttattacttggaggtcaaaagggaatctgtgattgaagtgttaagctgacaaaatctgtacagaatatttaatttttccttttatttctgtgatacaaagattgtgtttcttttcatagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaagaattcttataataattctcaagcaccatcgcctggcttgggaagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtag

SEQ ID NO: 100505 - DNA, 1806 bp, Homo sapiens
gagtccagctgccgtcgccgccgccagcggacggggcggggatcctggtgccaggtcttcgttaacccgcccccgcctgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggtaagtaaataaaatgtatctttcataatgtaagaaaactctaaatggcttgactaaaatcatatggattaaaaattgtcttgccattcctattctagtgggagacagacagtaaataagtgaataaatagataaattcagatagtgacaactgttatgaagataattagcagggtaatggaactgagagcatcttggatcaagaggtattaagaaagctttgaaggcaatatgcgagagagatttaaaagacattaatacagccggacacggtggctcactcctgtaatcccagcactttggaaggctgagccaagagactctcttgaggccaggagtttgcgaccagcctggtcaacatagcaagaccctgtctctaccaaaaattggaaggaaaa

SEQ ID NO: 100506 - DNA, 4093 bp, Homo sapiens
gagtccagctgccgtcgccgccgccagcggacggggcggggatcctggtgccaggtcttcgttaacccgcccccgcctgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaagaattcttataataattctcaagcaccatcgcctggcttgggaagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtag

SEQ ID NO: 100507 - DNA, 4169 bp, Homo sapiens
gagtccagctgccgtcgccgccgccagcggacggggcggggatcctggtgccaggtcttcgttaacccgcccccgcctgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaagaattcttataataattctcaagcaccatcgcctggcttgggaagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtag

SEQ ID NO: 100508 - DNA, 3524 bp, Homo sapiens
agagagagagagagagagagagagagagagagaccagacttttgaggatgaaatataatgttcattatttactaagtgtatggccttgaataaataacttttgtgcttcagtttcatcctaaatagaggtaggataataatggtatctacctcataatgtcattgtgagtactaaatgagtaataaacatgtaaaacacttagcacagtgtctggcccattcaaggtacacagtaaatgttagctgttttccttatcattgtcccttcctcccactctcctagcaagctcttcctgattagcgttttattatgtgccttgtatttgattacaggctgatttctgtaactattcacaggtttcataatttgaattgtaaactcctcaaagccagggagcatttattaatcttcttattacctacaccatagtgcctagcacacaattgtgcttaatatttattgactaagtatgtagaattttggaggagctgtcatgaaaccagtatttataaatacaaatctggtttttagctgtataatttttatccttgacctggttgaaaacaaactgtaataattacatttcaggagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaagaattcttataataattctcaagcaccatcgcctggcttgggaagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtag

SEQ ID NO: 100509 - DNA, 455 bp, Homo sapiens
ataaaggttatacagctatcttcacctggtacactgtcttcggtattacctttagttttaaatgaagtgttttcttaagaccaagaattttaaattgaaattagttattttataaagggctctaaataaggatatgactacaatggatgctgctgaaagaattgaatgataaagattattaggtggcttaatgctttttgtattaatctctgggaaagtccattattgatcccaaaattgccaaggctgatcagacaggatcattacattctttctgtgctttttcaagtacttgaagtgtttttatgtaatttaagcatttttcactaatctttcttttttagtgtaactttgtataattttatgttcctttttcttaggagtctcagcagtccaattttggcactggagaacaaagtgagtatttctttccctctttgttttcaaattaagct

SEQ ID NO: 100510 - DNA, 815 bp, Homo sapiens
cctgatggcttactttgaactaaatgccagaaataatatactctctccttattctgatacttctgtctccttggcttatctaacatacacattgtaatcttaccagacctcacccagacatatttggcattaagattaggcagaaggcattgaatgaaatcaaacttagggtcttgcttttctgttttcctcctcatgtgcttttgaaatttctcttctgatttcttcccctgacaaaatttttctacgagtatatataggctctatagccagacttttgaggatgaaatataatgttcattatttactaagtgtatggccttgaataaataacttttgtgcttcagtttcatcctaaatagaggtaggataataatggtatctacctcataatgtcattgtgagtactaaatgagtaataaacatgtaaaacacttagcacagtgtctggcccattcaaggtacacagtaaatgttagctgttttccttatcattgtcccttcctcccactctcctagcaagctcttcctgattagcgttttattatgtgccttgtatttgattacaggctgatttctgtaactattcacaggtttcataatttgaattgtaaactcctcaaagccagggagcatttattaatcttcttattacctacaccatagtgcctagcacacaattgtgcttaatatttattgactaagtatgtagaattttggaggagctgtcatgaaaccagtatttataaatacaaatctggtttttagctgtataatttttatccttgacctggttgaaaacaaactgtaataat

SEQ ID NO: 100511 - DNA, 244 bp, Homo sapiens
gggagtacaggcactggccaccacaccaagctaatttttatacttttgtagagacggtttcactatgttggccaggctggtctcgaattcctgggcttaagcgatcttcccacctcatcctctcaaaatgctgggattacaggcatgagccactgctcccggccaagacatgaaatttcaagtagggatgtacatacaattacaggagcccttcaagtcacctgtcatactccgtacctggcct

SEQ ID NO: 100512 - DNA, 894 bp, Homo sapiens
agcggagctgctgcaacccgctgccgtctggtgtcctgctgtgggagctttgttctttcactctcgtaataagtcttgctgctgctcactctttgggtccgcactgtctctgtgagctgtaacactcaccgcgaggttctgtgccttcgttctttaagtcagggagaccacgaacccaccgggaggaacaaacaactgtgatgcgccatctttaagagctgtaacattcaccgccggggtctgcggcttcattcctggagtgagtgagaccacgaacccaccagaaggaagaaactctggacccatctgaacagctgaaggaacaaactccggacacaccatctttaagaactgtaacactcaccgggagtctccgtggcttcattcttgaagacagcgagaccaagaacccaccagaaggaatgaattccgcacacagcaacagcacaaagttaaaccaggaagtccctctgccttgctagggatccaggtttgccttcctgttgaggtatcccatttcattacagttgacctaagtttgaacaaacactgccacctgatgcatgaaagctctactgtgacctacgttaaaaggagctgacactccctcaggctaccttagtcagtgggggcttactgcagcatacctgtggcgatgagagagagaggcacatcacaggagcatctggcaccagtggcatcctggtgagtggaacccccagctattagagggtcccacccaaactcagtttgattacacagtcaccaatctagctggtggtccgaaacatattctcttacgatctcataccatgagacacctgaaggggggctgttggtgggacgtgatcagtgggttgccgaatgtttgcttggggaaagagctggggagac

SEQ ID NO: 100513 - DNA, 975 bp, Homo sapiens
agcggagctgctgcaacccgctgccgtctggtgtcctgctgtgggagctttgttctttcactctcgtaataagtcttgctgctgctcactctttgggtccgcactgtctctgtgagctgtaacactcaccgcgaggttctgtgccttcgttctttaagtcagggagaccacgaacccaccgggaggaacaaacaactgtgatgcgccatctttaagagctgtaacattcaccgccggggtctgcggcttcattcctggagtgagtgagaccacgaacccaccagaaggaagaaactctggacccatctgaacagctgaaggaacaaactccggacacaccatctttaagaactgtaacactcaccgggagtctccgtggcttcattcttgaagacagcgagaccaagaacccaccagaaggaatgaattccgcacacattgttgtattataggtaagggctagagtattggcgttggagagacggactaaattctcagctccaacccttaccagcttgggcaacagcacaaagttaaaccaggaagtccctctgccttgctagggatccaggtttgccttcctgttgaggtatcccatttcattacagttgacctaagtttgaacaaacactgccacctgatgcatgaaagctctactgtgacctacgttaaaaggagctgacactccctcaggctaccttagtcagtgggggcttactgcagcatacctgtggcgatgagagagagaggcacatcacaggagcatctggcaccagtggcatcctggtgagtggaacccccagctattagagggtcccacccaaactcagtttgattacacagtcaccaatctagctggtggtccgaaacatattctcttacgatctcataccatgagacacctgaaggggggctgttggtgggacgtgatcagtgggttgccgaatgtttgcttggggaaagagctggggagac

SEQ ID NO: 100514 - DNA, 351 bp, Homo sapiens
ctgcttcctccaacttaaatttgtccaacggcagcctttgactctaggctaacgtactagggaaatgcccacagcaccacctttcgcctctcctggctttgcctccaaagggctgggcacaccaagcttgcagaactgaattaaatcagagaaccatctcgccacttacatgaatttcccaggtagcaaagctttaagcccctcaagcttctcttaggatgcctttggctggacacagtagtagctcacacctgtaatcccagtactttgggaggccgaggtgggtggatcacttgaggccaggagtttgagaccaacctggacaacatggagaaatgccatctctactaa

SEQ ID NO: 100515 - DNA, 462 bp, Homo sapiens
gcccactctggcatgagaggctgcctgattcttgaattgttctttgctcagttaaacactgtgaaacttacctgagctaaagttttccttttaacactgagcatcctgtattttatctgttaaccctggattgatatttacaacttctttcttccatacccattctatgttcctttggttcttttacttcatgaggtgacccaaacttcattcctgaagggtctgagtccttggttattctgcttgtattgagtcacttgaggctttcattaacactgtcactgaacctggcaatcctcagagatatttcaggggatcccctggatacgatggactccttgtctccgttgtatggcagcaacagcttctcggtggacagtcagggtcagtcttcctcttagagctcttggtcctgaggcaaagcgacagcggggcagcctttacttccggttcaaaaaaagc

SEQ ID NO: 100516 - DNA, 530 bp, Homo sapiens
  misc_feature (46)..(46): n is a, c, g, or t
  misc_feature (59)..(59): n is a, c, g, or t
  misc_feature (61)..(61): n is a, c, g, or t
  misc_feature (74)..(74): n is a, c, g, or t
cataatcacacctgcaaccgcgaaacccgcgtgtgaagacgccgcnggagacctccgtngnctacgacaaaatnctggttataatggaaaattgcaaggggtttttcctgatctactttgaaatgcaattccgcttaaagcttttcttagtgcctaaagtgtctgcacatggaaatccagaggtagacagagagaaactgagttccggacaatgcattcactaaagaaagtgacttttgaagatgtagctattgacttcacccaggaagagtgggccatgatggacacatccaagagaaagctgtacagagatgtgatgctggaaaatatcagtcacctggtgtccctcgggtaccagataagcaaatcctatataattttgcagctggagcaaggaaaagagctgtggcgggaaggaagagaatttcttcaagaccagaatccagacagggaaagtgcccttaagaaaaaacacatgatatccatgcatcctatcaccagaaaagacgcatccaccagtatgacaatgg

SEQ ID NO: 100517 - DNA, 262 bp, Homo sapiens
aataccaacagcaacacccttttgtatatcagcacagtgacattaaacttactgaaacaaacaaaaaaggagatacaacatattaaagcctttgggaagtagcaaagggaattccaaaagggaagtttatagccgtaaatgcctacattaaaaaaaaaaagatctcaaataaacaatctaactttatactgcaaggaactaggaaaagaaaagcaaactaaacccaaaattaacagaagaaaggaagtaataaaggtcatag

SEQ ID NO: 100518 - DNA, 262 bp, Homo sapiens
ttcaagcgatcctcccaaagtgctgggattacaggcgtgagtcaccatgcccggcttcttcccctgtgttcttacgtactacttatattttgatgcttatcacaggacattcccatgcttatcttactcctgtgttgagaaagacagtagactgttatgtggtgataaatatcgtcttaaatcctcataataaggcaacaggtctaattacccagtttataggaaactcataatcattaccagttttgagaaaaagttggag

SEQ ID NO: 100519 - DNA, 314 bp, Homo sapiens
cagtatatttcacagatggttggttgaattgggatcagaataggtgtgacacattacatttagttactatatctcatatctaagggatttctctttctcttttcccttaaaatttatgttcaagaaacagaattataaatcctatccagtctcccatattccttattttgcttcccgcatccctctggtgttatttaacatctcctgcctcctgtatttcttattaacttgtattaagatctagaggcttggggagcttcaggtttgattttttttttttttggaacaagtacttcataggtattgctgagatg

SEQ ID NO: 100520 - DNA, 262 bp, Homo sapiens
tggtaaccatcagaggctagtggaatgctccctaacaggtgtgtgcatttctgtttctacaagcaaatgtcagaagagtcaatagtgtttgctcccaaacgtgatcgtaccagttgtaaatgacatactgtaaatgtcatagttaaacattatataaactgaaagtgtgaaaatgaaatttttaaacaataactcagagattctataaagattaactgccgagcgcagtggctcacgcctgtaatctcagcactttgggagg

SEQ ID NO: 100521 - DNA, 236 bp, Homo sapiens
tgtaatctcagtcagaagaagccacgctagtacagttactagttgactgctcgcagccagtttattgtgttcaaaatgcttttgtttaggggaaagttacctagtatgatttcacctggggtggaatcacagggcacctttatctgggaatgtctaaatggagcaaagtctttagcacattcaacagacgtgcttttgaataaatatgttcaatacacacagaatgaaaaatacag

SEQ ID NO: 100522 - DNA, 368 bp, Homo sapiens
atgctgccaaaagtgagaatgaagtttggagtggatttttctgcaaagccccagatgacaactcagcctggctaacaccctgatttcagctttgtgataatttgaccagagagcccagagaacctagtgagctattaaataattgtaattaattttaagctgctaagtctgtggtaatttgtcctgcagcatcagaaaactcatatagcaggccatgtgcagtctctggtgcagatttttgctctttttttctacttttcttggataatagttaaacatttacaaacctttattaacttgtgggccataaaacaaaaacaaaaatcaggccacaagatgagctgtcatttgctgattcctgccctaga

SEQ ID NO: 100523 - DNA, 691 bp, Homo sapiens
aatgctatcctttattggaccatgcctttgcccatttgttctatgactccttttgtgctacagtggcagagttgagtagttgctacagagactgttctggcctgcaaaaccaaaattctttaccctcttggcttgttacagaggagtttttcagcccctgtatgacaacatcagtaacttggtcttttaattctagaaagtaattatttctgttagagattaaacctggaaacagcctattttagaaatagtgtattatttgaaatggtcaatggacttctgaattctggtgcagagtgtttttttttcataatactataaaagttatatttccttttgaggaactaaaatgcaatcttcgcctgtggtttaggaactgggttttttgtttgtttttttttttccttcttacaagagctttttatgggagaagttgtatgtatatcctttagcctatcttgaactattctgtagcttctaaacaccttccttgataaagagtatatctgattttcttgtgtcttttgaaaattgttctgaaatagaactgtaaataaattagtggtttttaatggtcacatacatgatatttaattaaagttattcagtgggattttgaagatagaacaagaggtgattcatgtattttataaaaccaggtcttcagggatcagtcatctttaaaaaaaaa

SEQ ID NO: 100524 - DNA, 1094 bp, Homo sapiens
ctaaagagtcgccgcagacaagcaggcccccagatggagaaccagcctgtgaggtggcgggccctgccaggcctcccacgccctcctgggctccccgcagccccctggctcctccttggcgtgctgctgctgcccgggaccctgcgactggcaggaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagacgcagggtaccgagagcccccgcagagtccacagaagctcctgctctttggcttcaccggcctcctgagtgtcctgagtgtagtgggcacggccctgctgctctggaacaagaagcggatgcggggtccagggaaggaccccaccaggaagtgcccagatccaagatctgccagcagccccaagcagcatccttcagaatctgtctacacagctctgcagcgccgcgagaccgaggtctatgcctgcatcgagaatgaggatggcagctcacccaccgccaagcagagccccctctcccaggagagaccgcatagattcgaagatgatggcgaacttaacctggtctatgaaaatctctaggatgggctccacacgctcatagagcttgccctgggtcagaggaccggggcagcccctgccaccaaaggacttgatctgagttgggagtaaggcccccaggaacaccccatcatttcaccctcacattcaaggcccttcctgtcttggccggccccactgcccccccattctatgccccaaccaccaaggctttcccatcttggggcctttgcccaggctgttccttctgccaggcaggcccttcctcc

SEQ ID NO: 100525 - DNA, 981 bp, Homo sapiens
ctaaagagtcgccgcagacaagcaggcccccagatggagaaccagcctgtgaggtggcgggccctgccaggcctcccacgccctcctgggctccccgcagccccctggctcctccttggcgtgctgctgctgcccgggaccctgcgactggcaggaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagaagcggatgcggggtccagggaaggaccccaccaggaagtgcccagatccaagatctgccagcagccccaagcagcatccttcagaatctgtctacacagctctgcagcgccgcgagaccgaggtctatgcctgcatcgagaatgaggatggcagctcacccaccgccaagcagagccccctctcccaggagagaccgcatagattcgaagatgatggcgaacttaacctggtctatgaaaatctctaggatgggctccacacgctcatagagcttgccctgggtcagaggaccggggcagcccctgccaccaaaggacttgatctgagttgggagtaaggcccccaggaacaccccatcatttcaccctcacattcaaggcccttcctgtcttggccggccccactgcccccccattctatgccccaaccaccaaggctttcccatcttggggcctttgcccaggctgttccttctgccaggcaggcccttcctcc

SEQ ID NO: 100526 - DNA, 452 bp, Homo sapiens
gtaaaaaggtaatccatggaatggtagcgaacatttgcaaatcatatatctgataaggggttaatatccagaatatataaggaacttctacaactcaacaccaacaaaaaacaacacagttaaaaaatggagagttctccaaagaagctatacaaatggccaataagcatatgaaaagatgctcaacattacaaatcataagacaaatgccaatcaaaaccacagtgaattatcacctcccacccactgggatggcctctatcaaaagaaaagaaaataacgtgttggtgaggatgtggagaaattggaacccttgtgcactgttggtggaaatgtaaaatgatgcagccactatggaaaacaacatggaggtgcctcaaaatattaaaaatagaattatcatgtgatcctatttctgatacatagatacatacctatttctgggtatatat

SEQ ID NO: 100527 - DNA, 854 bp, Homo sapiens
atctgggtttggtgctgggaactgttgcatctacgaggtaaaaaaaacaaagtcagcgtccattatgaaaggaagaaaacttgtcgggggctaaagcaagaacctgtcctagctggccggttgttggcctggggatgttttgtatcccaacctccctgcagtagttccccagagcctacaaaatgaaaaagaaagtactcacacatcttctatttttaggattctaccccgtgggcacttgcacatgtgtacaaaaaaagctcgggatccagctttattgggggacacggggggaaataacaaaaaattggaaacctagtcattcatcgatagaggaaagacaagatatactatggtacattcgcattttgaaatactgtgcagctcttgagcaagataaatctgcgtgaaaagatcaagataaattgagagaaaaaaaagccaagttgctgcaaactatatatttgcacacataggcatttaaatgtgaaggagtaagtctgaaaggggaaagggcaaagtagtaactctgagggccaggattcggattggaggaagaaggtggtcaagagctactttaccttcatttgtattttaaattttttacaaaacaaataattttaaagtatatttttaacaaagggaagaaaataaagctccaaacaatgtgaaaagtagaggaggctttccaaatgctgtggtccaccttgatttatagaactttcctgcctaaacaatgtttctgctcaaatgaactacttcctgggtgctaaaatactgtttttccagccttttttgcccaacaaccacaataaatacattttacatcttatcacggtacacctatacaaaat

SEQ ID NO: 100528 - DNA, 260 bp, Homo sapiens
cccccaaatcaacactgtcccaaggaccaacctttcaagccacagcttgaattcaggcttacttgtgcctacctgctcacctttagggcactcatcctccccctcagctcagggtcagccagcatgtgaactgggtacctctaggcctgggattttcaacttgtggatgataaaacattagggagtccagggagtcatttttgtggcccatgaccaacgtgttgtttaaagaaataagaatagaaaaatcagaatgtgtt

SEQ ID NO: 100529 - DNA, 328 bp, Homo sapiens
ctcaaaaggaaataagccatattttctaataaacacaaagagaaggccaggcgcagtggctcagcctatgctctcagcatcctaggaggccgaggcgagtggagaattcaagaccagcctggacaacacggcaaaaccctgtgtctactataaatgcaaaaaatcagctgggcaggcatggcatcacgggtctacagtctcagctacttgggaggctgtgatgagaggactaccttgagccccagaagtcaaggcttcagtgagctgtgatgcactccactgcactccagcctaggcaatgggagtgagaccctgtgctaaaaaaaaa

SEQ ID NO: 100530 - DNA, 373 bp, Homo sapiens
ggatttgttctaggtatgcagggctggttcaacatttgaaaatcagttaatgtaatttaccatgtcgataaactaaagaataaaatcataaatcatatcaattgacacagaaaaaggatttacaaaacccacatccattcattatgaaaaacaagacaaaacaggccaggtgcggtggctcacaccataatcccagcactttgggaggccgaggcaggcggatcagctgaggtcaggagttcgagaccagcctgaccaacatggtgaaacccagtctctactaaaaatagaaaaattagctgggtgtggtggcactcacctgtaatcccagctacttgggaggctgaggcaggagacttgcttgaacctggga

SEQ ID NO: 100531 - DNA, 370 bp, Homo sapiens
ttataatatttgcctttagaatgtcttaatcctgattcccaactgtattaactaattcagaccacaggcttaatgagtgatcattgattggtgtctttgtcttcttatgtagcatttttttaacagagccagataaggacaagctctgtggtaatataacagaatgattagcagtgcacctatttggttttacaaggtggatatgatgacaatgtacaaaaaagaaaaacttatttctgtagacttattaatttctaccctgaatgcaatatcaagcatgtattattgatttttatgttatgttcagctaaaaagtccttcagtctagagatttcagataataaaaagtccaggtcagaacagtcccgac

SEQ ID NO: 100532 - DNA, 464 bp, Homo sapiens
aggaagaagtgggcagtttccattgatccctagcatcagtttgacgggaaaaccggtgcatttcatcaacctcaaggaaaggaagtgccatgcatggaggcctggtgataggcaacatccatttagaagaacagtcacacaagcaacagaagaactatccaagactagaagcttagaagcttataccaaactctctgtctctctctctctctctcacacacacacacacagagtggatgggaggggacattaagaggaaccctagtgcagttcccccaaaaaaccttggcatagagtataacagggaaaaagtaattactgggaagctgaaaacaatcaaatatgtgaggaatgactgaatatgagctgaggataatgtaaattgttctggattgtctataagataaagatacagagcctgaatctatgtttttctgaataaagagaccccatattctcttttg

SEQ ID NO: 100533 - DNA, 334 bp, Homo sapiens
gagacaggatatcactatatgttggccaggctggtcttgaactcatgaccttaggtgatctgcctgccttggcctcccaaagtgctgggattacaggcatgagccaccacgtccagcctagttggaaggcattgttgatgtaagttttcatcaagcagagttaattcaaacacagccttgggaatatgcccagagaatgtaaggtggcttactggctgtcaataaaagaaatgccaactcctcagtcctcagcagctccatgttggagcgagaaaggctttttttgctttatgagttgttaggagagaaagccctggaatggaaggcaggcaag

SEQ ID NO: 100534 - DNA, 552 bp, Homo sapiens
cagcatcagtcatggacttaaccttcttttgttaatgagaccttagaaatgtaaaaatgatacactcttctttaaaataattgtagtcagtacacataactcttaccatcttaaccatttctaagtgtacagttcagtgacattaaatatattcacatttttgtacagccatcgccaccctccaacctccagaattcttcatgttgcaaaactgaaacactgcacccatgaagcggggactcccctgcccctggcagctctttctgtctctgagtcccactactctaagtacctcatacaatatttgtcctttgtgactggcttacttcactgagcatagtgtcctcagggttcctccatgctgtagctgtgacaggagccccctcctgttaaaggctggataacattccactgtatgcagacgccacattttgatcatgagaatgcccgtttgtggagggacacactgttgcttccccctcgtggctgttgtggataatgtcgctgtgagcatgggtgtgcagacatggctttgagaccctgttttcagtt

SEQ ID NO: 100535 - DNA, 459 bp, Homo sapiens
atgattataccactgttccccaacctgaacaatagagcaagactgtctctaaatgaagtatacagagttttagtgtattcagagttgtgtaactaatcatcacaatctaacgttataacattttcaacacccaaaaagaaaccccatacacattagcagtcattcctcattcccactccattctccccagctggagccccagtcaaccccaaatctaccttctgcctgtatagatttgcctactgggggtcaggtacagtggctcacacctgtaatcccagcactttgggaggccgaggcgggtgggtcacttgaggtcaggagttcaagaccagcctgggcaacgtggtgaaaccccatctctactacaaatataaaaattaccgggcatggtggcaggcgcctgtagtcccagctactcaggaggctgaggcaggagaatggcgtgaacccgggagg

SEQ ID NO: 100536 - DNA, 404 bp, Homo sapiens
ctcggaattaacagaaattaaaactgcatcaaaaaatacctgtcttcaatttctccatcgaccaggcaaatagctgtgtacattttcctgtagttaaaaagaacaggccggacgcggtggctcacgcctgtaatcccagcactttaggaggtcgaggcggatggatcacctcaggtcaggagtttgagaccagcctgaccaacatggtgaaactctgtctctactaaaataaataaataaataaataaataaataaaataaaaattaaaaaaaaaagtagtggcacatgcctgtaatcccagctactcaggaggctgagacaggagaattgcttgaacccaggaggtggaggctgcatgagccaagatggcgccattgcattccagactgggcaacaagaccca

SEQ ID NO: 100537 - DNA, 325 bp, Homo sapiens
gataaagcaatcgctcagcaaatgcataacaagtgaactcagtaccaaatacacactgagatcacagtgcagtaaaaatagaagactaagaaactctgcactcaaaaacaacagaatatgcattcctcacatcatcatatgccacatactctaaaatcaaccacataattggacataaagcaatcctcagcaaatgcaaaacaactgaactcataccaaatacacactgagatcacagtgcagtaaaaatagaagactaagaaaattgctgaaaatcatgcaattacatggaaatcaatcaacatgctcctgaatgactttttaa

SEQ ID NO: 100538 - DNA, 437 bp, Homo sapiens
ctgtaatcccagtactttgggaggctgaggtgggtggattacttgtcaggagttcgagaccaacttggccaacatggtgaaaccctgtctctataaaaatacaaaaaattaactgggcatcgtgacaggtgcctgtaatcccagctactcaggaggctgaggcaggagaatcacttgaacccaggaggtggaggttgcagtatcagctgagttactcctctagctgatatattttatctagccatcattctgcagatggtggtggtggacacataatcatagaaataataacggtggctatttattgagcccttcctccttcctatatgccaggcactgtgaatgacccacaccctttagattcagggtttaaatggcagacactggcaagaactattaacttagccaggcgcagtggctcatgcctgtaatccaag

SEQ ID NO: 100539 - DNA, 158 bp, Homo sapiens
cggggagtctacattgcttataggagaaagtccagacgtgcaatatcttctataacctccacccttctcactcgctgtgccccttcttccccacctcagccatcctaaacagctggcagttctctgaacatatcacacttcactcacaatgtggcttc

SEQ ID NO: 100540 - DNA, 282 bp, Homo sapiens
tgtttgtacctgtgtattttatactgtattctgtaatcacactgcattctgtagaactccaatatcaataaagtgcccttggcccagatgaagcggttcttggctcgtaaccagacctgttgacaggctggactggccatgcctcacatgtacaaggctggccccgggggaggcaggtaactttctgagaattagaggtgattctaactcatgtaggcattaccagccacaaccatgcaccccgggatgttgggatccagatgcctgcacggccgtccaacc

SEQ ID NO: 100541 - DNA, 960 bp, Homo sapiens
tacaggatggagatctagtttcaggcctttatgaaagcatttatctcctgtatgacataggttctctgatcctgtttctttaacataattggatagtgaaaatatattctacttgatagtctcaaatgaagaacatctgtatataaggagtatatgaaataccatgactgttgatcatgctgagaggcctttagcataggggagtgtgtaacataccatgactattgataacgctaagaggcatttagcataggtgatttttttgactcattctacctaccacctacaaatcgtaaccaacctgtgaagccagcgtcccatcttatccttatgtagtaggggagtaataatgtttcaacctatatttatgtaagtaagccgcccttaggagcagctattatttgggtaacacagaggaattagataggggaagccacaagattttttttttattttgacagtcctcactctgttgccccaggcaggagtgcagtggcatgatccctggctcactgcaacctccacctcctgggttcaaggaattctgcctcggccttccaaagtgctgggattacaggcgtgagccaccgcacccagctgaggaatattttttataactgagctaagaatgtgtactatccttgttagtggtgacagttgggaaacataaaagtgtattaatattcttttatatattagaagaacttcattttgagtccatcttggtatgtattccaaatataaactacgtaagtatgtctggcagaaaggcatagttagagcaagtgttttaaaatattgcttaattaatggtttccaattggctgcctgcagatcaaagtaagacgcaaatggttcaccactagagagtaagtttttttttgtttttattttgttttgttttgttttgtttttttttgagacagcctgggcaacagaacaagactgtgtctcaaagga

SEQ ID NO: 100542 - DNA, 194 bp, Homo sapiens
ccactgcactcagcataggtgacaagagcaagaccctgtctcaaaaaaaaaaaaaaaaaagaaaagaaatcaatagaagagtcacatggccagtgggtggcaagtcaagaagctttgagctgttttctccagaaaatagacattgggaaggtggaagtattcaccttctcttagatcacactctacagaggaac

SEQ ID NO: 100543 - DNA, 352 bp, Homo sapiens
tactgaataggtgtgggttgaattgatgtcatcgggaatcaggaactcccttggtggatgacatcatcgggcagtctgtacccaggggtggggatgaagggtgtaagataagtgaggtttttctcaccattgccccactatggaacaggccaccttgcaaggaagtgagcatctctctggagtgtctgagcagaagcagggtacctgtttgccagttatgcttgggaacagagtctgggattggacaggggggtggggcccaggctacaggccctctgaagacctgagttctgagattgatgagtttagagatacagacacagaaggggcttcagagatcatggagttcaag

SEQ ID NO: 100544 - DNA, 312 bp, Homo sapiens
ggagggaggatcctctatagtggacactcctttatttaaaaaatgtttaataaaatattgtttatagtgaaatcagctccccaaagaaggaactcctacatgcccaaactaattacagttgaacatactgattaaaaatgccatagatcacagctagtcaggaggcctcaaataaactgcaaataatgcttaaaactttaaaagaaggagaaccagcagtcttccgaaccatgggacagttccaaggtaatagcctaccttgcctaggataagtgaagtcctaaatgatggctatcttcagggcctggagca

SEQ ID NO: 100545 - DNA, 454 bp, Homo sapiens
gagatttcaccatgttgtccaggctggtctcaaactgctgacctcaggtgatctactcgccccggcctcccaaaatgctgggattacaggcatgagccacagcacctgtccccaatttaatttttttttatgtaaagtattagcatgattccaatattaaaaaaaatggaccagaggagattctctctcctgtcctatcctcagcacccagttcccctccccacaggcctctcagatgttacatgctgataactatgtacatgtattccttaaatgtttttttaagttttatattcttggcactggtcttcaaatgtgtacatgtgtgccagggagcaaatgccttcttgtttctgaaattggtcttttagactgttcttttttcccatcttctcacctcctgcccctccttcagggtacttccgtggccagaacccctccaggtcagaggcag

SEQ ID NO: 100546 - DNA, 634 bp, Homo sapiens
aggctggagtgcaatggcgatctcagctcactgcaacctccacctcctgggttcaagcgattctcctgccttagcctcctgagtagctgggattacaggtgcccaccaacacgcctggctaattttttgtatttttagtagagatggggttttgccatattggccgggctggtctcgaactcctgacctcaggtgatctgcctgcctcggcctcccaaagtactgggattacaggcgtgagccactgcacccagccacatcaatcaacactttgattgtctccacattctggctactgtgaacatgggtgtggaactatcttcatgaagccctactttaatttcttttgtatatacccagaagtaaaattgctggatcacatataattctattttaaaattttttcttagttttaaattatcttttggagacagggtattgctctgtacccaggctggagtaagtggcacagtcacagttcactgcatccttgacatcctgggctcaagagatcctcctgcctcagatttccaagtagctaggactaaaagtgtgccaccaccatgcctggtgaattttttttattttttattttttgaggcaggtcttcctctggcactcaggctggagtggt

SEQ ID NO: 100547 - DNA, 700 bp, Homo sapiens
ccaacctaatatttgactgagctcttttctgttaaagctgcaccattgccatgtttctttttcttttattttcttttcctatctcagtctttgtgaggaaatcagaagattttctgagtcagcagcattgcagtttctttttttatgtgataagaattcctgcccatttaattgaaagtatatagtaatgaaaagccttataacgtcgggcctctagcaatgcgattatacagcaatgattataaagctgggcaagtaagacaaaggctcactgggtaaaagaacattcaataaaggataacttatggtcagagaatgacaaccaatgtatgtagtccagaaggactttaaaaatgcatatgtacctatccctgaccctcctttttgtttgccaatctggatattatctaaacaacacaattagactaatatgccctatggctggaaattgagactagggaagtctctggttattattgatctgatctcgtacttcataaaatttaaaaagttatacacatctaaagactccattaagaaaatgaaagagcaaaccatattcagaaaaagctgttctcaaatcataaacctgataaaggtcttaaacccagaaaatacaaacaacttcaacaaatcaatgacaaaatgacgattcaaacaataataaatgatttggagtcttcgcaagagtagatgtcca

SEQ ID NO: 100548 - DNA, 232 bp, Homo sapiens
ctggcctgatcccctcccagcctgagcccctcctggcagtttggtttttctccactcggcctttgcaccatctttatgtttccagtctccccagctagaaggtaagcgccaagagagcagggaggcttccctcttgtgcactattcacacccagtcccgggaacagtgcctggcatgtggcaggtgttcaataaatattcatgacatgaacaaagtcatgccgtgtggccag

SEQ ID NO: 100549 - DNA, 551 bp, Homo sapiens
tgctcggccttagtcccactggatgcggcgagggttgaccggtcaggcccttgctggtggcctgggtagatgtctggagagggggcctgggctccggactcctgcccttcccccatcagtgatcctatcccacactctttggcgatggtcagtgagctgggcaggggcgggggtctgtccctgtccctcaggtggagatgtccaggccagtgcccacaactgggttagatgggctgcacaaggctggggaccagtctcccaggctgtcggggggcttcagtaatggctgtgggaagacccagcacgtgaggagacgggagcttagaaattttgtatggccaggtgcggtggctcatgcctgtaatccaagtactttgagaggccgagtcaggcagatcactcaagtccaggagttcgagaccagcctgggcaacatgacgagacccctgtctctactaaaaatgcaaaaaattagccagacttggtgatgtgcacctgtagtcccagctacctgggtggctaaggtgggaggatcacttgagtccaggagg

SEQ ID NO: 100550 - DNA, 489 bp, Homo sapiens
taagaagtactatttggaaaataaaagggttgggaatatagggctactttaaacttggaggtcaaaggtctctctggggtgacatctgaattgagatctaaatgaatggcaaggatgaggctgataatgtctgagtgtagggctttccgggcatacagaatggcttgcacaaaggccctgaggcaggaacaagtttggcaagttggagacacctaacgaaagcccaggcagctggagcataatgaatgaggctgtgattcttggcagatgaggtcagagaaaccagcagggcccggatcacatgaacctcatatgccactggagaattttaagctcctatccaccagctgtaaaacctcagaccaattacttaatctctcagagccttagctttcttatcccaaaacatgggatggcaacacttcatatggtttgtcaaagagcaatgttaaaagcagagtagacaccaactccataaatgtttaatca

SEQ ID NO: 100551 - DNA, 873 bp, Homo sapiens
cccttccctacacatcaagctcaaggatttgcccccgcccaggactggcaagttagctttactcaacatgcaccgagtcacaaaaactaaaatacctcttagtctaggtagacactttcactggataggtagaggcctttcctacagggtctgagaaggccacacagtcatttcttcccttctgtcagacataattcctcagtttagccttcccacctctatacagtctgataacagaccagcccttattagtcaaatcagccaagcagtttctcaggctcttagtattcagtgaaacctttatatcccttacggtcctccgtcttcaggaaaagtagaacggactaaaggtcttttaaaaacacttcaccaagctcagccaccaacttaaaaaggactggacaatacttttaccactttcccttctcagaagtcagacctgtcctcagaatgctacaaggtacagcccatttgagctcctgtatagacgttcctttttatttggtcccagtctcattccagacaccagaccaacttagactgtgccccaaaaaacttgtcatccctactatcttctgtctagtcatactcctattcaccattctcaactactcatgcattccctgctcttgtttacactgctggtttacactatttctccaagccatcacagctgatatctcctggtgctatccccaaactgccactcttaactcttgaagtaaataaataatctttgctggcaaggctatgctgaatctccttaggtactctaattagatgtcctaggtcctcccaattcttagacctttaatacctgtttttctccttctcttattccgtttagtttttcaattcatacaaaaccgtatc

SEQ ID NO: 100552 - DNA, 1024 bp, Homo sapiens
  misc_feature (986)..(986): n is a, c, g, or t
aaaaaaaaattaacagcatataacatcaaggaccttgtaataaatctaatataatccagacctctatagagaacattatacagctttaataagagataccaaagaagagctaaataaatggagaaagatataatgttcacggatagaaagtattgtaaagatgtcatgatttaaaaagtcagtaaatcaaacaaaaccccaatagggaccttcatggaacttgatattagaatttttaaatttatattgaggaataaagggccaagacatttctgaagaagaccagagaggacttaccctactagataccaggatttttattttgaaactctaatggaacagattagtgagcccagaaacagacccatggatatatgtacctctgatatatgacaaaggtggcatatcagatcttgtgggaagatggaatggctcaccaaatgaatccctatggaaaaagatgcacttaatccctccctcacgttataaagaaaatcaaataatggccttacagtaatattgtttgacttattgtaaacaatgacttaataagttgaaaaggataaatatcttttagaccctaaggaaatattaagacacaagcattcatatatttgaccatattaaaatacttttgttcattgagaacttttactcactaaaaggcaatttaaagaaagtgaaaagacgatgcataaacaaacttggagaaggtaatcataatatctacctacacttgacagaggattattatcaagaatacagagtattttatcatagttaaaaataaaaatttttaaaagatcacataaagaacttttttttgagatggagtctcactctgtcgcccagcctgggccaacctgggtgaaaccctgtctctacttaaaaatataaaaaattagccagggcgtgggtggcacacacctgttggtccccagctacttcgggaaaggctggagggcagggaggaagtgcttgaaccncgggggagttgggaggttgccgttttccccaggttggt

SEQ ID NO: 100553 - DNA, 3171 bp, Homo sapiens
  misc_feature (1205)..(1205): n is a, c, g, or t
attaaagtttccacgcatctttttccaataccgaaaagatacatgcccctctaagtagtttcctatagaagaagctaatgtggctaaaacttgatgggaagtccgacccagattcccttcatattgcccccaataatgtccccatttattcaggagactaaattcagatcccagaaaactaaacagtaaggtcaacctaatgatttgtctaggttttaagtgaagcccagtggccaggtgggtatggagatgtgtcactggtgccaagaagtgtccctgtcacaaagcctgccgacacctagccacttaggttaggcaatgaatgaaggcgcttgcgcagtagagtccagagcggggaagcgggcgcctgcgcagagacatagtgaccgtccgctcgccgccccgcctctgccaagccgcgccagcgcagtgaataacgagccagcagagacagcgtctgcgcagccgtggctgaggagcctgtggcggcagcggcgatggaaccagcggagcagccgagcgagttagtgtcagccgagggccgaaaccggaaggcggtgctgtgccagcgttgcggctcccgggtgctgcagccagggaccgctctcttctctcgccgacagcttttccttccctccatgagaaagaagccagctctgtctgacggcagcaatcctgacggcgatctcctccaggaacactggctggttgaggacatgttcatttttgagaatgtgggcttcaccaaggacgtgggcaacatcaagtttctggtctgcgcagactgtgaaattggaccaattggctggcattgcctagatgacaagaacagtttctatgtggccttggaacgagtttcccatgagtaactgaggggaggggtactcagctccatctccaaagataaacctactccccacaagaactggcctttaatgtggtataactgttccgctgccttcttgtctgtgctaatataaatactgagtaccagcatgtccatttgaacatgcagagggttaatcctgcttcctaaagcctcaagtacatgcctcctgcttagttcactttgtatcacatttcctaagctcccttttcccccagttttgggacactgtgcttacctccaaaaatctcatctcttccctggcattctccctaggctctgttttgcccaggggctcccgctttttcttgctctagangagcagtattcaaccttttagctatgatgacacataacaaaagatgtttatgtactaatagttgaaatctgcctttttctcattcaagaaggcatacaaatatctgagagtgactttgttgtatggctacccttgtgatctacagtaatttattctttctaaaagtaaagcattttcaaaactcagtatttaaaccactaaccagaaacattactttggatgcatctctaataccatgtttgagcacctctgctctaggttgagaatgacattttattgtgaagatgggtgtggtccctcttcccttgaaatcttgtagtttctttttatattagctcctcactgctacagcctagaaggtgagaagcagattttaaccccatctggcagccattcaaggaaaacccagccctggctgtttactcaggctctcttagaatgagagtggagggtgtaggatatgagggttaggcctttgccacattatacaaaagtttataatttgccacatctggacaagtaactttcttcttttgttcataggcaagacttctttaatggatagtatcatttactgaacctactgggcatggtcctcatggagttttggttcaactggaatctctgtgccaacccaggatacaaacttccatccagatgcatggatacaaatttccatagctccggggctgctctaacagtttgatatcagcagacgtgtttaagccttcaacttgatttccaattattccatcatttctattctgaaatgactcactgtcgtagaaggaagtttattatataaccaaggtttcaggtatcctcctgtcaccacctctactattcaggaggcctaaaattgaaataagtactaaacagaaaccttaccatctgaagtcccttccattgttttctagttgcttcctcattcctttacccccaaactttctaagggctccccgactgcagtgcaaggtggccttgggcacagttttgcaaccaacctactcccctggaaagatggcttccttctccaattagcctgaatgagctttagtaagcaattgagagaactgtgtttttccgacaaacggtcacatgtccatcgttatggcatgtgcagaaaaacagagttatccacacaagtcaggagcaaaacccaagtagatgcctctaggggcatatggcccctcacatcacaagccagaacctaagctaagcattttttaaattgagtttgagactagcctgggcaacatagtgagaccccatctctatttaaaaaatgaacaaaattacctgggcatagtggtgtatacctgtagtccctgctacttgggaggctcaggtgggaggatcacttgagccccaaagatggtggctgcagtaagccaagatcacaccactggcactccagcctgggcaacagagtgagaccctgtctcaaacaaacaacaacagtaacaacaaaaaaatatatagcgacttgaataggaaaccatagtatttcattgttttaatttgcatttattttatttctagtgaaacttttatatacgtatcggtcatttctatttccttttttgagaactgccaaatgttgccctagtagccaaaaatatcaggttgctattctgccttttcagtttgatctgaaagaaataaaggcatttaagcaatggaaattagatttctgcatgtccttgggaagaatatataaattgaaaaaacaaaggagagctgaaacctgaaccttggggtttagcttaaggtcaaccaactgattatctagtcagctataaaatgcaaacgtcatttcttcatttccctcacacctaataggctctcagtacatacttgtgaatcagctgctatttgctgtgggtagatagaggcaacctgtgctttctgctccgagtatagaaacttccgttttctattggggagagcagttgattttgtgaaa

SEQ ID NO: 100554 - DNA, 1343 bp, Homo sapiens
attaaagtttccacgcatctttttccaataccgaaaagatacatgcccctctaagtagtttcctatagaagaagctaatgtggctaaaacttgatgggaagtccgacccagattcccttcatattgcccccaataatgtccccatttattcaggagactaaattcagatcccagaaaactaaacagtaaggtcaacctaatgatttgtctaggttttaagtgaagcccagtggccaggtgggtatggagatgtgtcactggtgccaagaagtgtccctgtcacaaagcctgccgacacctagccacttaggttaggcaatgaatgaaggcgcttgcgcagtagagtccagagcggggaagcgggcgcctgcgcagagacatagtgaccgtccgctcgccgccccgcctctgccaagccgcgccagcgcagtgaataacgagccagcagagacagcgtctgcgcagccgtggctgaggagcctgtggcggcagcggcgatggaaccagcggagcagccgagcgagttagtgtcagccgagggccgaaaccggaaggcggtgctgtgccagcgttgcggctcccgggtgctgcagccagggaccgctctcttctctcgccgacagcttttccttccctccatgagaaagaagccagctctgtctgacggcagcaatcctgacggcgatctcctccaggaacactggctggttgaggacatgttcatttttgagaatgtgggcttcaccaaggacgtgggcaacatcaagtttctggtctgcgcagactgtgaaattggaccaattggctggcattgcctagatgacaagaacagtttctatgtggccttggaacgagtttcccatgagtaactgaggggaggggtactcagctccatctccaaagataaacctactccccacaagaactggcctttaatgtggtataactgttccgctgccttcttgtctgtgctaatataaatactgagtaccagcatgtccatttgaacatgcagagggttaatcctgcttcctaaagcctcaagtacatgcctcctgcttagttcactttgtatcacatttcctaagctcccttttcccccagttttgggacactgtgcttacctccaaaaatctcatctcttccctggcattctccctaggctctgttttgcccaggggctcccgctttattgtcagatagaagataacctttgcttgttggacttacaaaatggtgttaacatttaaatggcttgccctcggaagttcgagggattatagaccagggccggaattccaagaggtacacgacacgggggcgaccaggaccgcgcggagccc

SEQ ID NO: 100555 - DNA, 2498 bp, Homo sapiens
  misc_feature (532)..(532): n is a, c, g, or t
ggaccctaaacagaatcctcactatggatggctggttgaggacatgttcatttttgagaatgtgggcttcaccaaggacgtgggcaacatcaagtttctggtctgcgcagactgtgaaattggaccaattggctggcattgcctagatgacaagaacagtttctatgtggccttggaacgagtttcccatgagtaactgaggggaggggtactcagctccatctccaaagataaacctactccccacaagaactggcctttaatgtggtataactgttccgctgccttcttgtctgtgctaatataaatactgagtaccagcatgtccatttgaacatgcagagggttaatcctgcttcctaaagcctcaagtacatgcctcctgcttagttcactttgtatcacatttcctaagctcccttttcccccagttttgggacactgtgcttacctccaaaaatctcatctcttccctggcattctccctaggctctgttttgcccaggggctcccgctttttcttgctctagangagcagtattcaaccttttagctatgatgacacataacaaaagatgtttatgtactaatagttgaaatctgcctttttctcattcaagaaggcatacaaatatctgagagtgactttgttgtatggctacccttgtgatctacagtaatttattctttctaaaagtaaagcattttcaaaactcagtatttaaaccactaaccagaaacattactttggatgcatctctaataccatgtttgagcacctctgctctaggttgagaatgacattttattgtgaagatgggtgtggtccctcttcccttgaaatcttgtagtttctttttatattagctcctcactgctacagcctagaaggtgagaagcagattttaaccccatctggcagccattcaaggaaaacccagccctggctgtttactcaggctctcttagaatgagagtggagggtgtaggatatgagggttaggcctttgccacattatacaaaagtttataatttgccacatctggacaagtaactttcttcttttgttcataggcaagacttctttaatggatagtatcatttactgaacctactgggcatggtcctcatggagttttggttcaactggaatctctgtgccaacccaggatacaaacttccatccagatgcatggatacaaatttccatagctccggggctgctctaacagtttgatatcagcagacgtgtttaagccttcaacttgatttccaattattccatcatttctattctgaaatgactcactgtcgtagaaggaagtttattatataaccaaggtttcaggtatcctcctgtcaccacctctactattcaggaggcctaaaattgaaataagtactaaacagaaaccttaccatctgaagtcccttccattgttttctagttgcttcctcattcctttacccccaaactttctaagggctccccgactgcagtgcaaggtggccttgggcacagttttgcaaccaacctactcccctggaaagatggcttccttctccaattagcctgaatgagctttagtaagcaattgagagaactgtgtttttccgacaaacggtcacatgtccatcgttatggcatgtgcagaaaaacagagttatccacacaagtcaggagcaaaacccaagtagatgcctctaggggcatatggcccctcacatcacaagccagaacctaagctaagcattttttaaattgagtttgagactagcctgggcaacatagtgagaccccatctctatttaaaaaatgaacaaaattacctgggcatagtggtgtatacctgtagtccctgctacttgggaggctcaggtgggaggatcacttgagccccaaagatggtggctgcagtaagccaagatcacaccactggcactccagcctgggcaacagagtgagaccctgtctcaaacaaacaacaacagtaacaacaaaaaaatatatagcgacttgaataggaaaccatagtatttcattgttttaatttgcatttattttatttctagtgaaacttttatatacgtatcggtcatttctatttccttttttgagaactgccaaatgttgccctagtagccaaaaatatcaggttgctattctgccttttcagtttgatctgaaagaaataaaggcatttaagcaatggaaattagatttctgcatgtccttgggaagaatatataaattgaaaaaacaaaggagagctgaaacctgaaccttggggtttagcttaaggtcaaccaactgattatctagtcagctataaaatgcaaacgtcatttcttcatttccctcacacctaataggctctcagtacatacttgtgaatcagctgctatttgctgtgggtagatagaggcaacctgtgctttctgctccgagtatagaaacttccgttttctattggggagagcagttgattttgtgaaa

SEQ ID NO: 100556 - DNA, 758 bp, Homo sapiens
tttttttttaaagaaattgacaagttgattccaaaatgtatatagacatgcaaatgacaagtttaagaagaacaaagctggaagatttacactcttaatttccaggctcactgtaaaatcacagtaatcaggacagttggtactggtataaaaatagacatataagtcaatagaacagaatagaaagtttcagaaacagactgatagatacatatatgattgacttttaacagagttgccaatgtaattcaatggggaatgaatagtctttttcaagggcagtgctggaacaactggatgtccatattcaaaaaatgaaccttgacccttgtctcaactcatatataaaaattacctcaaaatagatcacaaacataaaagttaaaactataaaacttctagaagaaaatgtaagagaatgtcttagttactatgagttaggcaaaaatttttagatgaggtattaaaaagcacaatccataaaataacaaattgataaaagggacttcctcaaaatcaaaatctgctactcatcattaagaaaataaaaaggaagtaacaaaataggaccaaacgttgatttgataaagaaattatgtccacagtaaagaatacttacaactcagcaagataacaaccaacccaacaaaaaaatgaaaaaaatgtgcgaaaactgtgaataaacactttaccaaagaagacacatgaatggcaaatacatatatgaaaagatgcttaacatcattaatcattaggga

SEQ ID NO: 100557 - DNA, 521 bp, Homo sapiens
agacattgcctgatcttatgccttagttgtgttatttgtaaagatagtagttcctagttcattgagattgttgtaaggattataatgagctgagaggcataacagtctgtacacaaaacctgtgacatagcaaatgctcaagagctgtaattaattacttacagagcataagtggattgagttgaatgaagtgggaaaaattggcaaatttggtccctttcattaccccttggttcctattgacttctcggcagcacatgtgctctatacaaaatggggagagtgaacaacactgggaacttgattaaaaggttatagaggtactccactatcatttgagtcatcctgtgttggctttgtaaatattcaagggacatcagaatgtgggaaaaaaagtcatgggatttttttttccagtaatcagttagccatcaggtattcattgcattctactttatactcaaagacatcaatgtaggatcagaacaaatgtaagacttggtgtctgctttaaaaaaaaa

SEQ ID NO: 100558 - DNA, 318 bp, Homo sapiens
cggcctctgccaagcacagtgcctggtatgtggtaggtgccaacaaccatttgctgagttaacacacattgaatgaaggcgagagctgggcaccccaggtaattccaaaccataggtgacccaaagtggaactagagaccctggattcgggctttcagacacaggttatagacccagggaggggacgcctgggtcctgggagaagatgtcaggagcagcatcttcccagagatgaggtggaacatgcagttccaggaaccagccaccaggtggcgaagtggctctgcccagggtggggataccaggggctctaaattg

SEQ ID NO: 100559 - DNA, 657 bp, Homo sapiens
aggaattacagtgattcctgtgtaaattataactggtaattgaaatacttattttaatcatgattaaattatttttctagtttacacatgaatatgagcaaatttttaaatttaaaatgaaggcatactgaaaaagaatcaagtggcgatgcagaacctagtacaactggaacagtaaacagactcaaagaaggtatgttgcagatttgacaatgaatggcaattgcagtttgctgtggcagagcaaaacaagctgctatttaagaaacaaagtaggaaaattgagacttcagcagatgcaaaatgaattgggtaaattatatttcatatgccaaaaagaatcaatgaaatttagtcacctaaaatcagaattaacaagagtttttaaaaacaattttagaaggaactaaggttgtaagtttggccagatgtgaaatagctgagattctttttttttttcccgagacagagtcttgtggtgtcacccaggctggagtgcaatggcgcaatcttggctcactgcaacctccacttcctgggttcaagtgattctcctgcctcagcctcccgagtagctaggattacaggagtgtgccacgacgcctgcctaattttttttttttgagacagagtcttgtgtcacccaggctggagtac

SEQ ID NO: 100560 - DNA, 438 bp, Homo sapiens
tttagtcagaaattttgctgagattttgccatttccacccatatctgataatcacattttatgtctgtttccccatctgtaaaatagaaataataaatttgtacctaatacataaggtagtggtaaagataaaaggaggtaacacaaagcatttagaacagagcctggcacataaaaaattactaaatattagctgttattcttacctccagttaaatatagttgctggaatgtgtgttgccttctctttagtctttccctctctttaggatcttaagttcatcttccttagaaacaactttaaaaaaaaacaaaaaaacagggtttccctatgttttccagtctggcctggaactcctgggctcaagtgatccctgcctcagcccttaagtagctgaggctgcatgtgcacgccaccacaccccacttaaaaaatat

SEQ ID NO: 100561 - DNA, 904 bp, Homo sapiens
cagattggtcctagctattcctaatgtcatcgtttcagtagagtttcacaaaggctacgctacacgagttgtttaatctaaaataccttcccaggccgagtgcggtgctcacacctgtaatcccaacagtttgagaggccgatgcaggagtattgcttgagtccagatattcaagactagcctgggcaacatagcaagaccccatctgtacaaaaaattaaaaaattagctgcacatggtggtgcatgtctgtagtcccagccacttggaaggccaaggcaggaggatcactcaagcccaggagtttgaggctgcagcgaaccatgatcacaccattgcattcctgcgtgatagagcaagaccctgtctcaaaacaaacaaacaaaaacttcactaaggttatactgtaattacacattgaaacacagatacaaataatgaggcgaatgcttgatattaatgagattttaactaagaaatgactacaattctatattttcttgaaaagaaacaaccaagtgcatactcgtgtgctgctcaaagatctagggaccagcagcttattagaaatggaaaattgtaggccctgtcccacagcattctaaataagaatctgcgtttaacaagatacccattaaagtttgagaagcattgctttacacagcctcagaaaggaaggtaacacaatgtagaaggaactgtgttacattttgttaccaacatataaaagtgttacctatcacatgtcacataataaaattgaaggcaggagaaatttctttatcccttaaaattaattaaaaatgcatttaccttaatctttctagttttaatgttgttttcttcttataagccacttagaatgatttttatgccctagtgctatttggccttgtctgctaat

SEQ ID NO: 100562 - DNA, 480 bp, Homo sapiens
accatccctgttctcatgaacctaattgttattcaaggttataactaacacaagacttaatctgagcccaagtcaagtataaagtgtgaaatatccaaataactgtcattaaaatatatttggaggcaaataatgcagagaaaacatttatcaggcacatttttccaccatgaaaggaaatgctatatactttgatcacaatatttttttgtctgtcaccctaggtctgtatttgaaaaggagatatagaaaactaaaagtccagaatataccatatcttaccttctatttgggatctagaatttctagactaaagaggaggctacaaaaagttaatcaaatatgatatttactaagcacctatcaagcaacctaccaccttggaggtggactctgggacacagaggagaatgaatcagctttacccctgaaagtacagaaacctagacagttaaaaaccaaataattataatgcaaggt

SEQ ID NO: 100563 - DNA, 302 bp, Homo sapiens
caattatattgtacccatttgtatagtaaaacaatttgtgtggccagtggaggaaatatcttttctcacacagagatataggtcattatatgtttatttccacatttggacagaaaccttttaaattataattgagaagttagtaatttgtatttggcgttttctgtttctgttcgccccactcctttctcacaaatttagcagtctgatatccgaagctgtatttgttatagaaagtttgcagggttaatggtagaaggttcatttcaggtataaaaaattgtgtgagtaaaagtatggag

SEQ ID NO: 100564 - DNA, 514 bp, Homo sapiens
tggggtcctgccaaggcactggtggatgggatgatacctacgggatgcactggcaggggcagacgtttgctccaaggccatctcccttccatctcctctccctgctcaggctcatagccctgacctgaggcccagctagaaaggcagaaggcatcctcccacacagagcacacagctccttccctgcatcagaaccctcggtggcaccatcaagttggacagatatagtcaggcgaggtggggggtcactgcagaggacaagaaggtcctgtcctggaatctgcagccaaacacctttggccacagactgaaggctgcactgtcagcttccctacttttgaggttttgggacttggactgatccatcactggctttcttgcacctcaacttgcagacggtctgtcgtgggacttcaccttgtgatcgtgtgagtcaattctccttaataaactcccttacatatgtacatacatcctattagttctgctcctctagagaacgctgactcacaca

SEQ ID NO: 100565 - DNA, 462 bp, Homo sapiens
  misc_feature (6)..(6): n is a, c, g, or t
tccttncctctctcacgatccttgcctatctcacgatccttccctctctcgcaaacaaactaacggaactatcagaactaattatctcatgcacaatcatttatgactccactgtttgcaaaacctcttttggtctttgtaccatccacataagagcaatcaaacagctcgctaaaaatcctgtgaaactacccccaagacatcacctatgacgcttaaatgtcttcctgcatcacttcatttttgccattaaaaataatcaacattacactttgggaggccgaggcaggcggatcacttgaggccgggagttcaagaccagcctggccaacatagtgaaagcccgtctctgctaaaaatacaacaacaaaaaaattagccaggcatggtggtacacgtctgtaatcccagctacttgtgaggctgaggcacaagaatctcttgagcccaggaggcagaggt

SEQ ID NO: 100566 - DNA, 154 bp, Homo sapiens
tccaagcccagcatgccccacactctagaaagtggggaggggccaacaggaggggggtcggtttctgagggcctgctgaatgccaggcccacccttgcccacgctggggaggcagcatagccatccccatgacacagcacaggtgcccaggtct

SEQ ID NO: 100567 - DNA, 557 bp, Homo sapiens
tgccacttcaggaagccaccagaggagcagcttcctggctagatggccaaagtgttgaaaacttgctagaaaggcttcactctgttggtcacaataacacacaccctaaaagagcaagaaaggtcaagagctccttcttccaaggaccacttctgccactgataggctgaaccagtgccttcatctgagcagcgaaggggcgtaaatgagcagggacacactcctcagaccttctgcctctggctctgcctactcatttgtagaggcactagtgcacagcggttaaagaggaaggctgcttcacatctcagctccatcactcacagcacagcaaatatcttccttgctggttgtgtggaagtgatgggttgaggaaggaagactagatctccatttctggcttatgttttatgatttataatttcagagcttgcttttttttcttctgtcacaatgccattaattgatgataaattttcctctaaataagcacaacatattagccaccagctgtcttgcccaaggttgtaactagatctgtattataaaacatgata

SEQ ID NO: 100568 - DNA, 324 bp, Homo sapiens
atatggctgttatgtgctggcgataccccgggtgtgtttagcatttaggagggcagtgtgggcgcagaaaggtcagtagggttgacacccaaggagaaaggagagagtggctgaagtgggagaggtacataggagtccttcactgggccaggtaggcagcggtgtgatggtgaatgtcatggaatctgctctatgtggtagagaaaacctgatctttagcatttgctgattcctgtagtgtaaatactcccactgtggttgatttcacatcaccacttgaggtcactaaaagtggagctggaactattcacaatagcaaagaca

SEQ ID NO: 100569 - DNA, 448 bp, Homo sapiens
ccagcaaattgtgccactgtgctggcaggaaatgaaaactgctcagagcaagtggagccaagagagctgttgaaatgaaaggtaacatcaagggtgtgatcactaactcacacaggcgcctcaggattccaggatgcaactttctgcttcactggggaaagcatgaggccctctcatctgtcagccgatgtcaattctatataggggctgagatagactggaaggtgggctctgtgaattaagctttgttgtgcttgggtaaatgtaggggtttgggttgtttttattcccccaagaagtgtctcctaggaaaaacagaaataagaaaaagtttttgtttttgtgtttttcctgggcccaaacacttgaagaccaaattaagtaaaaggaagattccaaaagcactataggtcctattaatgtgggattagacagtgtgaagggagga

SEQ ID NO: 100570 - DNA, 470 bp, Homo sapiens
gcacaatctcctcattcctcccagattctaccccctggctcacccctactctcaagctattcttgtgggcatgcaaagcaaccattactgacaacgtgatgaatatgtcatttagcataaggttaggacattttagaactggctgataaaagattacttcaaaaccaaccagccaagtcaccagatcaacaggtctcaaacttccttctctccacttcactctttctcactgccagagatttggtgttttattatttgtctccccaggttacatgaatcccccaatcagaaccaacagaccaagtctggaaaatggaccttcagttttcgatattttcatcatttctcctcagctctccaagacctccaattttctgtatctctaattcaatttcagaaaaaaaaaaataaggagacaatgccttctggaagagtccctttctctcacccaatttagagtccggaaacac

SEQ ID NO: 100571 - DNA, 831 bp, Homo sapiens
aaactgactttattaagcaaatttgttccaaactttaaaaaatttttaacttaaaaaaatataaagtacctatgtatctaaaccccagaatagtttattcacaagtgaaaatgcaacttaactgccactgcctctgggatctctctattgggagttgctagaaaatactgtgatgagcttgagtatctggttttccaacatgccaaattattagaagtaggaagaggtagtttaagggcagacacactaacagcagatgaagaactgacaatgaggaaaaaaaaatcaataaaaagtaggtgcaagaatccaaaagcctaacagctttcacccactaacacaattgtcctacataattaaagactctggatgcactattctgttacctccagggtataataacgtatctaataataattttgaatcagtaagataaaatgacaatgtgctcagaagtcatttcagtgatttctggggaagggagtgaagttgaaaagggagaaggtgtgaaagtttgaaagagggccaggttgagaatcagtctgagaatgaaaacacccaaaactgaatattaacgctttacaaaaacacaccctaaaaaattttaattaaagagagacaaacagacatgagcctatttagaaaatcccaaggactctaaccaaaacctcctaaaatgaattcagcaaggttgcaggttaaaagaacacacataaattaattgtatttgtaaataccagcaatgaactggaagccaaaataaaaagtttgaacaccatttacgataccaaaaaactgaaatgtttaaaggtataaatttatcttgtgcag

SEQ ID NO: 100572 - DNA, 478 bp, Homo sapiens
gggttattggtacaaacccagaaagccatttctcacaaataattgacgtactagtctttacgccacctaatgctagattaagaattgttgcacattttggtgtttctaaaagtcactgaggagctaatacgcaatgtctcttttcttcagtgaaacttaattcacaaaagaatttgacagtgaactcatgatacctatattcaagcataatgaattgaaatttcattttagaatctggattctttcacagttaaatattctaaaaatggttcccacacacagattccaattgaatgctccagcattctcccttgggttttgggggcacctgctgctcattcagcacctagtctgaaaatagtaactaattgccagggcttgggttaaggcttgaaagtgcagggggagggatataaggcaaataaccaaaagtcttgaggtgacttaatgtgatgcctcctaaagtggcacagagtat

SEQ ID NO: 100573 - DNA, 149 bp, Homo sapiens
tgaaggaaagaccctggctttcctccccagctccaagtgggctgttctgattgcttccgggtcctgtcctcatggggagcagcaccacgggagactctgcctctgctgagttttctaacattagtgtcgggaaacaagaatctgccact

SEQ ID NO: 100574 - DNA, 603 bp, Homo sapiens
gacccacatatgcactaaatggcacttctgtgtagtgcttcccacattttcacatcaggacgcaaatagaaaatgataataattgtcaacacactaagaaaaacagataagttgcttgcagccagaacaattttccagggctctggccactgccagctctgccccacctgaggataagaagactagtatttctgcacaccagatggcaatctctgttctattggcctaacacttccctttacccccacctcccccacaggaactgactcagagcaagaggacagcttcaattccccatgatttcatctctagcccaaccaatcaacactctcgactcactgatcttcccctacctaccaaattatccctaaaaactctgatccccaaatgatcagggatactgatttgagtaataataaaactctggtctcccacaaataataataataataataataataatagaagccaagaaatgtagagtccaaagatccaacactgtgtgactctagatattttacttcacctctaatttacaaatagaaatatttgtaaatatttcttttcttcctggccttagagagtaaagtaaggatcaagtgc

SEQ ID NO: 100575 - DNA, 310 bp, Homo sapiens
ttttttacagaggtaaactgttttgaaatgcttgacttttgtgtgaaatgggtatatcatttaatcttctttaaatctgggtagataccactaccagcctgaaggtaagtcacaaaacatcaagaaaaatgttgatatctcttagatatggctaagttattttttcattttttaagacagcagggtctgtataaaatatatttgagtagagctcatttccattaatgaaaacaaagtggcacattataatgtaaattccattattttaaataaaagctgacaaagggatgaggaagcaagtgttactaac

SEQ ID NO: 100576 - DNA, 392 bp, Homo sapiens
  misc_feature (318)..(318): n is a, c, g, or t
  misc_feature (391)..(391): n is a, c, g, or t
ggacaaagaaaagaaactagtgccatgtgatatcacagaagcagaagatggcattttgagaaagtaggcatgcacaacagtgtccatgcagcagagaggtctagcaagatatagattggaaaatgtgggttgattttccaatgaggggcttgttggtgaccatgcaagaggagttgaacaatgagattacatggacacagggaggggaacatcacacaccagggcctgtcaggagttggggggcaaagggagagagagcattaggacaaaaacctaatgcatgtgggctttaaaaccttgatgacaggttgataggtncagcaaaccaccacggcactgttattacctattgttaacctggcacgtttcagcacttgttttccccaggaant

SEQ ID NO: 100577 - DNA, 379 bp, Homo sapiens
ggacaaagaaaagaaactagtgccatgtgatatcacagaagcagaagatggcattttgagaaagtaggcatgcacaacagtgtccatgcagcagagaggtctagcaagatatagattggaaaatgtgggttgattttccaatgaggggcttgttggtgaccatgcaagaggagttgaaacagtgaatggaagtgagaaatttgaaatggaaagtggagacagaaacgactggtccacatgaggggaaggggttgtggaccaggccacaagttggggagaattgactttgagtagagagaggatatctttcttggcagtgtcagtaagggtgtgtgtgaatctggctaggagggaattccgcgaagatcactcttgggtg

SEQ ID NO: 100578 - DNA, 599 bp, Homo sapiens
tcttttggttaaatgacaccaatgggcaaaaaaaaaaaaaaatcaactgaaacaaaagaatagactgaatttgccaaaagagtgcttaaatggagacctaagtcttcaaagctaaggtgatgagaaaagaacaggtcttaaatttcttcagagcttcaagaggcaaagcttgaaagaagaaaaaattttattcttaggtaagatgtaggggtagaatggtggcccctgcaaaaggtaagccttcctcctaatcctagaatcgtggatggtaccttatttggataaaaaggtctttgcagatgtaattaagaaccttgagatgaggagatcatcctggattatctggtggactgtaaagtcaatgacatgtattcatatatgacagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgtttta

SEQ ID NO: 100579 - DNA, 1056 bp, Homo sapiens
gtacgtgggcgggcggatcgtggtggctgcgcttgcgaggaccctgaggtagattgggtggtttcaacaggaacgcatccactgtctgagaggtggcaattgaagccggaagaacatctaccaagagcagagaacccaggaagaaaattctgcctctttaatacgttccaatatggacgttttccatatagatacctatctatatagatagatgctctgggatctgacggtcctggacacctgtatggctgtgtgctgtggtctttgcctagcctgcggttcacttttgctctggccaccacctcccctcatgtacaaaccgcgtctctgctctgccagtcttggcccccgtcaggcagcggttcactccctcaccagggaagtctagatagatagatatagatagatatcgatcgatagatatagatatatatatagatagatagataggtagatatatggatagatatagatatttggatagatatgtagacgtctatctataaatatatcgatatatcggggttctcagccatcccaaagaagcttgcacagggccagttgctttatgtcaggaaaagggacacagactgagtgtatgagggttttttttttctatagatgtatagatatttatatcagatgcaaataagtgaaactctcatacaacttttaattttgtgttttttccaaactctattccattcaactttttctgcctttttatttgattataatgagacatcgtactggaggcaggcttgaaatggatatacagagcactttcaacccagaaatttgtctcacgacttggggtccttacttaagttgtagctgttagtaatttcatccatgaattcactttgtgccatagtgtgatgttttgttatgaagttggaattgggaagggaaactaggaagttttgggagaagttaagaaggttgagtaggcaggcgttgttatagatattaaatttcaccctgcttatcaaagtacctggagcgtatggtatccaagctgtaaatggcccaaaggaatcggggttctcagccatc

SEQ ID NO: 100580 - DNA, 367 bp, Homo sapiens
gtacgtgggcgggcggatcgtggtggctgcgcttgcgaggaccctgaggtagattgggtggtttcaacaggaacgcatccactgtctgagagtttaaacttgattttgtgaggggacgaacagcgtgacaattaaaagaagatctgggaatcgaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgtttta

SEQ ID NO: 100581 - DNA, 963 bp, Homo sapiens
gtacgtgggcgggcggatcgtggtggctgcgcttgcgaggaccctgaggtagattgggtggtttcaacaggaacgcatccactgtctgagagtttaaacttgattttgtgaggggacgaacagcgtgacaattaaaagaagatctgggaatcgaaaagcttcctgaggccttcaccagaagcagatgctggtgccgtgcttctacagcctgcagaactaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgttttaagccttcagtttgtggtagtttgttacagaaaccctgtaaagttaatacacagagttcaaagagaatccggtaatatctctaaaagactcgtgtattagtcaggattctccagagaagcaaagccaatagaatgatacatgttgttaaagcaaattaaaatggagaccatgcctgaagaatctctgtgcagagaaacccagttaggcctcataagttaaccttacttgatttgcaaacataatctaaaagttaactggagctatttccggtaaatgaatataacacaacttaagctcaatcagtcagaagcagctttataattatgtagctagggactttccaagaggatgaccaaagaaggaaatgatataactataaccaaataaatattttctttgctttcctgttcctcctataaaagcctccccactgctgagctgtgctcagcagagctccgaaacaacttctggtttagagttgcccgatttgtgaatcactgtttgctcaaataaactctttaaaattttatt

SEQ ID NO: 100582 - DNA, 672 bp, Homo sapiens
gtacgtgggcgggcggatcgtggtggctgcgcttgcgaggaccctgaggtagattgggtggtttcaacaggaacgcatccactgtctgagagtttaaacttgattttgtgaggggacgaacagcgtgacaattaaaagaagatctgggaatcgaaaagcttcctgaggccttcaccagaagcagatgctggtgccgtgcttctacagcctgcagaactaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactatttatatatcagctttttatcagttgaaataaaccaccctgggccgggtgcagtggctcacacctgtaatcccagcactttgggaggccgaggtctggaaagcatggaaatttgtatcttcattcacttttgttttcatggactcttttcatgtttgaacttttcatggtatgagctgttttataatctataatatggaatgtttctcatacgaatgtttttcttattgaagaatgccatagaaataagggtgtgaggtatactta

SEQ ID NO: 100583 - DNA, 579 bp, Homo sapiens
gtacgtgggcgggcggatcgtggtggctgcgcttgcgaggaccctgaggtagattgggtggtttcaacaggaacgcatccactgtctgagagtttaaacttgattttgtgaggggacgaacagcgtgacaattaaaagaagatctgggaatcgaaaagcttcctgaggccttcaccagaagcagatgctggtgccgtgcttctacagcctgcagaactaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtctggaaagcatggaaatttgtatcttcattcacttttgttttcatggactcttttcatgtttgaacttttcatggtatgagctgttttataatctataatatggaatgtttctcatacgaatgtttttcttattgaagaatgccatagaaataagggtgtgaggtatactta

SEQ ID NO: 100584 - DNA, 3326 bp, Homo sapiens
ttttttgcatatgttcacaatggaaagaaatcctaaatcttacttcgaagttagcaagaattacaatatttttcccaccccaattcatggccctctactttatggtcttatttcataggctttctgacatgttttgcttcaaagaggtcctattccccatcccatttcctatcttctggtttgggattacactcaagatgtgatatacagatagattagtttattagaaagaaaatatttttccacatggcgaactttagtggaggctaacaaatcagaatgtgctaaaatagccatgtgtacatatagacaatgggaagcttggaactgctttagcattttatacaaaagacttaaaagtaatttcagctgggcactgtggctcgggcctgtaatcccagcactttgggaggctaaagtgagaggattgcttgaggccaggagttcaagaccagcctgggcaacatagtgagaccctccccccatctgtacaaaaaaattacaaaattaaccaggcattgtggctcgcacctgtggtaccagctacttggaaggctgagacaggaggatggcttgagcctgggaggttgaggctttaatgagctatgatcatgccactgcactccagcctgggtgacagagcaagatcctgtttccaaaaacaacaaaaactggtttcaaatatattgctacattggaattctccataaaggaattaattgttgataacaatgccctcagtatactatttgtcaatacctataacaatgcaacaaacaaaaaagaaaatttaaatagctggaccacattaaaagttttattgggctaaaatcaaaaacatctgacaagtttttgacttgtctttctcatgatttaatgtcccagcagagcaactgggaacctaattctgaccaaaaaggaggaattgtttggctaattggaagtgacagaaaccttgggagaaagcaaccgcataccaaggataattataagaaggtaacatgggccctaaaggatagtgtcaagaaacctgaaacccccaaatgaggtgagacttgcaaaaaatgctaaggaaggacaaaaaacaggccttttaaaattctgttcagaaccagaagatgatcaagaaagggaaatgcccactagcagcttctactgtaaggttagagctgacagagaaagaactccttaactactatttgcttcattctctacaaaggaaactagagaagtgggttgacgtaatagaaagaacatgtgtttgtggggccaggcaaacctgggtttaattctgtttcaacactgcttaacaaaatttatgggaggctattgttttggattgggctcctgcaccaggcccctccggaccaaaccaaaatggagtcactcatactaaaactccaggtcactgaaccaaaactaagttgtttatctgaccttccaagaaatcaggagggagaaaacaaccaaatctccaaacaggccagttttaatcagcgtgataaggaagtcctctcttttttaaccctataaagaaagtaactttttgaaatgatcaatacactttgtattccttagttctgctttctttagcccctttctgcctataaagcccacttcctctgctcaacttactgaagcagtattccattttatagaatgagatgctgcccaattctggaatcactaataaaagccaattagatctttacatttgttgaaattttgtctttgacaacattactagttatattattctgggtatccttttccccatctgtaaaatggacatagcgatatccttcccatcagatttttctcattaatagaagtaatacattcaaaacactgagccaggctcacaccagtgagcaacttgttaatattactcagaagcatattatagatattgacagaaagcaatactgttcctaattaggggaagaaattctaagagagtacctaagagtttgaatttagattataacatttgctctgagtattttacattacagcctttggggggaaaagtacaaatgagatctgagaacagtggtactcatctttgaggaattatggaaaacgtaatagaacactaaacatgggaaaacatcggccttcaggttgaaaagtggaaatctcaatccctgaattttttttttttttttactaagtaacttttttgcccattggtgtcatttaaccaaaagaagaagaaattccaaaaaaaaaaaaaaatcaactgaaacaaaagaatagactgaatttgccaaaagagtgcttaaatggagacctaagtcttcaaagctaaggtgatgagaaaagaacaggtcttaaatttcttcagagcttcaagaggcaaagcttgaaagaagaaaaaattttattcttaggtaagatgtaggggtagaatggtggcccctgcaaaaggtaagccttcctcctaatcctagaatcgtggatggtaccttatttggataaaaaggtctttgcagatgtaattaagaaccttgagatgaggagatcatcctggattatctggtggactgtaaagtcaatgacatgtattcatatatgacagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgttttaagccttcagtttgtggtagtttgttacagaaaccctgtaaagttaatacacagagttcaaagagaatccggtaatatctctaaaagactcgtgtattagtcaggattctccagagaagcaaagccaatagaatgatacatgttgttaaagcaaattaaaatggagaccatgcctgaagaatctctgtgcagagaaacccagttaggcctcataagttaaccttacttgatttgcaaacataatctaaaagttaactggagctatttccggtaaatgaatataacacaacttaagctcaatcagtcagaagcagctttataattatgtagctagggactttccaagaggatgaccaaagaaggaaatgatataactataaccaaataaatattttctttgctttcctgttcctcctataaaagcctccccactgctgagctgtgctcagcagagctccgaaacaacttctggtttagagttgcccgatttgtgaatcactgtttgctcaaataaactctttaaaattttatt

SEQ ID NO: 100585 - DNA, 2795 bp, Homo sapiens
ttttttgcatatgttcacaatggaaagaaatcctaaatcttacttcgaagttagcaagaattacaatatttttcccaccccaattcatggccctctactttatggtcttatttcataggctttctgacatgttttgcttcaaagaggtcctattccccatcccatttcctatcttctggtttgggattacactcaagatgtgatatacagatagattagtttattagaaagaaaatatttttccacatggcgaactttagtggaggctaacaaatcagaatgtgctaaaatagccatgtgtacatatagacaatgggaagcttggaactgctttagcattttatacaaaagacttaaaagtaatttcagctgggcactgtggctcgggcctgtaatcccagcactttgggaggctaaagtgagaggattgcttgaggccaggagttcaagaccagcctgggcaacatagtgagaccctccccccatctgtacaaaaaaattacaaaattaaccaggcattgtggctcgcacctgtggtaccagctacttggaaggctgagacaggaggatggcttgagcctgggaggttgaggctttaatgagctatgatcatgccactgcactccagcctgggtgacagagcaagatcctgtttccaaaaacaacaaaaactggtttcaaatatattgctacattggaattctccataaaggaattaattgttgataacaatgccctcagtatactatttgtcaatacctataacaatgcaacaaacaaaaaagaaaatttaaatagctggaccacattaaaagttttattgggctaaaatcaaaaacatctgacaagtttttgacttgtctttctcatgatttaatgtcccagcagagcaactgggaacctaattctgaccaaaaaggaggaattgtttggctaattggaagtgacagaaaccttgggagaaagcaaccgcataccaaggataattataagaaggtaacatgggccctaaaggatagtgtcaagaaacctgaaacccccaaatgaggtgagacttgcaaaaaatgctaaggaaggacaaaaaacaggccttttaaaattctgttcagaaccagaagatgatcaagaaagggaaatgcccactagcagcttctactgtaaggttagagctgacagagaaagaactccttaactactatttgcttcattctctacaaaggaaactagagaagtgggttgacgtaatagaaagaacatgtgtttgtggggccaggcaaacctgggtttaattctgtttcaacactgcttaacaaaatttatgggaggctattgttttggattgggctcctgcaccaggcccctccggaccaaaccaaaatggagtcactcatactaaaactccaggtcactgaaccaaaactaagttgtttatctgaccttccaagaaatcaggagggagaaaacaaccaaatctccaaacaggccagttttaatcagcgtgataaggaagtcctctcttttttaaccctataaagaaagtaactttttgaaatgatcaatacactttgtattccttagttctgctttctttagcccctttctgcctataaagcccacttcctctgctcaacttactgaagcagtattccattttatagaatgagatgctgcccaattctggaatcactaataaaagccaattagatctttacatttgttgaaattttgtctttgacaacattactagttatattattctgggtatccttttccccatctgtaaaatggacatagcgatatccttcccatcagatttttctcattaatagaagtaatacattcaaaacactgagccaggctcacaccagtgagcaacttgttaatattactcagaagcatattatagatattgacagaaagcaatactgttcctaattaggggaagaaattctaagagagtacctaagagtttgaatttagattataacatttgctctgagtattttacattacagcctttggggggaaaagtacaaatgagatctgagaacagtggtactcatctttgaggaattatggaaaacgtaatagaacactaaacatgggaaaacatcggccttcaggttgaaaagtggaaatctcaatccctgaattttttttttttttttactaagtaacttttttgcccattggtgtcatttaaccaaaagaagaagaaattccaaaaaaaaaaaaaaatcaactgaaacaaaagaatagactgaatttgccaaaagagtgcttaaatggagacctaagtcttcaaagctaaggtgatgagaaaagaacaggtcttaaatttcttcagagcttcaagaggcaaagcttgaaagaagaaaaaattttattcttaggtaagatgtaggggtagaatggtggcccctgcaaaaggtaagccttcctcctaatcctagaatcgtggatggtaccttatttggataaaaaggtctttgcagatgtaattaagaaccttgagatgaggagatcatcctggattatctggtggactgtaaagtcaatgacatgtattcatatatgacagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgtttta

SEQ ID NO: 100586 - DNA, 1920 bp, Homo sapiens
cgggaagcagtggtatcaacgcagagtggccattatggccgggcaggagggagaaaacaaccaaatctccaaacaggccagttttaatcagcgtgataaggaagtcctctcttttttaaccctataaagaaagtaactttttgaaatgatcaatacactttgtattccttagttctgctttctttagcccctttctgcctataaagcccacttcctctgctcaacttactgaagcagtattccattttatagaatgagatgctgcccaattctggaatcactaataaaagccaattagatctttacatttgttgaaattttgtctttgacaacattactagttatattattctgggtatccttttccccatctgtaaaatggacatagcgatatccttcccatcagatttttctcattaatagaagtaatacattcaaaacactgagccaggctcacaccagtgagcaacttgttaatattactcagaagcatattatagatattgacagaaagcaatactgttcctaattaggggaagaaattctaagagagtacctaagagtttgaatttagattataacatttgctctgagtattttacattacagcctttggggggaaaagtacaaatgagatctgagaacagtggtactcatctttgaggaattatggaaaacgtaatagaacactaaacatgggaaaacatcggccttcaggttgaaaagtggaaatctcaatccctgaattttttttttttttttactaagtaacttttttgcccattggtgtcatttaaccaaaagaagaagaaattccaaaaaaaaaaaaaaatcaactgaaacaaaagaatagactgaatttgccaaaagagtgcttaaatggagacctaagtcttcaaagctaaggtgatgagaaaagaacaggtcttaaatttcttcagagcttcaagaggcaaagcttgaaagaagaaaaaattttattcttaggtaagatgtaggggtagaatggtggcccctgcaaaaggtaagccttcctcctaatcctagaatcgtggatggtaccttatttggataaaaaggtctttgcagatgtaattaagaaccttgagatgaggagatcatcctggattatctggtggactgtaaagtcaatgacatgtattcatatatgacagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgttttaagccttcagtttgtggtagtttgttacagaaaccctgtaaagttaatacacagagttcaaagagaatccggtaatatctctaaaagactcgtgtattagtcaggattctccagagaagcaaagccaatagaatgatacatgttgttaaagcaaattaaaatggagaccatgcctgaagaatctctgtgcagagaaacccagttaggcctcataagttaaccttacttgatttgcaaacataatctaaaagttaactggagctatttccggtaaatgaatataacacaacttaagctcaatcagtcagaagcagctttataattatgtagctagggactttccaagaggatgaccaaagaaggaaatgatataactataaccaaataaatattttctttgctttcctgttcctcctataaaagcctccccactgctgagctgtgctcagcagagctccgaaacaacttctggtttagagttgcccgatttgtgaatcactgtttgctcaaataaactctttaaaattttatt

SEQ ID NO: 100587 - DNA, 1741 bp, Homo sapiens
ttttttgcatatgttcacaatggaaagaaatcctaaatcttacttcgaagttagcaagaattacaatatttttcccaccccaattcatggccctctactttatggtcttatttcataggctttctgacatgttttgcttcaaagaggtcctattccccatcccatttcctatcttctggtttgggattacactcaagatgtgatatacagatagattagtttattagaaagaaaatatttttccacatggcgaactttagtggaggctaacaaatcagaatgtgctaaaatagccatgtgtacatatagacaatgggaagcttggaactgctttagcattttatacaaaagacttaaaagtaatttcagctgggcactgtggctcgggcctgtaatcccagcactttgggaggctaaagtgagaggattgcttgaggccaggagttcaagaccagcctgggcaacatagtgagaccctccccccatctgtacaaaaaaattacaaaattaaccaggcattgtggctcgcacctgtggtaccagctacttggaaggctgagacaggaggatggcttgagcctgggaggttgaggctttaatgagctatgatcatgccactgcactccagcctgggtgacagagcaagatcctgtttccaaaaacaacaaaaactggtttcaaatatattgctacattggaattctccataaaggaattaattgttgataacaatgccctcagtatactatttgtcaatacctataacaatgcaacaaacaaaaaagaaaatttaaatagctggaccacattaaaagttttattgggctaaaatcaaaaacatctgacaagtttttgacttgtctttctcatgatttaatgtcccagcagagcaactgggaacctaattctgaccaaaaaggaggaattgtttggctaattggaagtgacagaaaccttgggagaaagcaaccgcataccaaggataattataagaagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgttttaagccttcagtttgtggtagtttgttacagaaaccctgtaaagttaatacacagagttcaaagagaatccggtaatatctctaaaagactcgtgtattagtcaggattctccagagaagcaaagccaatagaatgatacatgttgttaaagcaaattaaaatggagaccatgcctgaagaatctctgtgcagagaaacccagttaggcctcataagttaaccttacttgatttgcaaacataatctaaaagttaactggagctatttccggtaaatgaatataacacaacttaagctcaatcagtcagaagcagctttataattatgtagctagggactttccaagaggatgaccaaagaaggaaatgatataactataaccaaataaatattttctttgctttcctgttcctcctataaaagcctccccactgctgagctgtgctcagcagagctccgaaacaacttctggtttagagttgcccgatttgtgaatcactgtttgctcaaataaactctttaaaattttatt

SEQ ID NO: 100588 - DNA, 597 bp, Homo sapiens
gtacgtgggcgggcggatcgtggtggctgcgcttgcgaggaccctgaggtagattgggtggtttcaacaggaacgcatccactgtctgagagtttaaacttgattttgtgaggggacgaacagcgtgacaattaaaagaagatctgggaatcgtaagtactgacagaatacctggagggaaggtgggactggagaatagtttgtgaaacagatcctgctgaggatgaatccagaacttcctgaagggttccgcttctgctgtgtagggacaaggttgtaaatagacaagccacaggcacctgcaaatggtaagtgtggtagagaggggctggaattgcctgttggtgtatctgtgggaagcagctgctatccttgaggaagaaaagatggagaaggtaagtggctatcaacctgtcagagacaacacattctgtgaagttgtactctttcatttctgacactgtggttcttaatatctgttctaaacctggcagtcattgaggttcgcaaagtatctccttctatgtgacagtaaaactggaattactatcagaatggaatccattcctgctagagtaaaaccatgaaaagaaatcg

SEQ ID NO: 100589 - DNA, 547 bp, Homo sapiens
gtacgtgggcgggcggatcgtggtggctgcgcttgcgaggaccctgaggtagattgggtggtttcaacaggaacgcatccactgtctgagagtttaaacttgattttgtgaggggacgaacagcgtgacaattaaaagaagatctgggaatcgaatacccatctcgagttctggatatgtgctctgagaaggtgcccatgtcaccgaccacactggaggccaatgcagatactgggggaaggttccatggtagctaagtgtggacaagctaatcactgaagttccctgatgcagagttgataatctctctagagttggatgaaagactgtgctgccttgaagctctgagagatgccatgccaattcaaggcagggtctttattgttgaaactcttgcgtaatgacatctttattcaggtgaaaatacaggatgaatttcaactatatgatattgtttatgttcctcagacatgttatttgtctttacaaagattggtttcaattgtgtgactgatattaaataaacatggaattttaccattcataa

SEQ ID NO: 100590 - DNA, 533 bp, Homo sapiens
gtacgtgggcgggcggatcgtggtggctgcgcttgcgaggaccctgaggtagattgggtggtttcaacaggaacgcatccactgtctgagaggtggcaattgaagccggaagaacatctaccaagagcagagaacccaggaagaaaattctgcctctttaatacgttccaatatggacgttttccatatagatacctatctatatagatagatgctctgggatctgacggtcctggacacctgtatggctgtgtgctgtggtctttgcctagcctgcggttcacttttgctctggccaccacctcccctcattttaaacttgattttgtgaggggacgaacagcgtgacaattaaaagaagatctgggaatcgaaaagcttcctgaggccttcaccagaagcagatgctggtgccgtgcttctacagcctgcagaactgaaggactttacagcttctctttcgcatatccaaattgccagcatcaccgctcttgcactccagcctgggcggctgagtgagactccatccccga

SEQ ID NO: 100591 - DNA, 116 bp, Homo sapiens
ggctcaaataggtgatgaaggggaattacaagaggcctgttagcctgtgagcctcatgacacctgcatgtcctggaacctgatgctaatgctttggcagtgggtcacagtgaccaa

SEQ ID NO: 100592 - DNA, 728 bp, Homo sapiens
cttagataaaacaaagctgagtggttgcagcatgcacatgttgtcttgtttacttttctttttctgtttttaatttttttccaaggactgctttactgacagatactcttccaaaatggacaggataaaaggagttttatatttgtcaggaagaaatgattcttcttatagcaatgagtttgtatacatacaatgttcatttcccaaaacatactgaaattaagggaacattagtatttgttgggtttggggtttattttaaaaattctaaaactaaacaactgtaggaaaggagaatatcacttccttctgattcttattctggatgtttcagcagagaatatgaaatgatgacagatttatacctaaacagacaagatgacttcaaaaaagacttttgtgcctctcttgtgtatgcttatatctgaattgacatttttttcctttaaagccaggcagtggttcatgcctgtaatcccagcactttgggagaccaaggcaggagaatagcttggggccaggagtttgagaccagtctgggcttaataagtgagaccctgtctctaaaaaacaattaaataaaataacaattgtcagtgcagtgctgttttcctgtagtcccagctatttgggaggatgacgctgaagcaggaggatcccttgagtccagaagttcaagactgcggtgagctatcattacaccactgcgctccagcttgggcaacaga

SEQ ID NO: 100593 - DNA, 424 bp, Homo sapiens
gaaatgaattattagtgagtgtgtgtagtttgaaggataaatctctaatattctagagtacaactagtttgtcttctattctagaaatgaaactatcttccccttcttataattcaaaatattagttcagtaatacagtacttttcactgaaaatatgacatgagttctataagttttcctgttgtatatttgtacagcaggtccttgaataacatccttttgttcaatgttattttattataacattgataagaaaaaaatagattcctgggccagagccactgtctgtgtgggaatttgcatgttctcctcatgtctgcatgggattctctggggtacttcggtttcctcccgcatcccaaaggtgggcatgttagggttaattgggtatgtctgcatgatcccggtgtgagttagtgtgtg

SEQ ID NO: 100594 - DNA, 262 bp, Homo sapiens
aaaccccacaaagctgtacaggaaagggaatataaatactagtatcgcctctgactcatttctgactaatgtctaagatgtcatcagaatgtaaatactgaatatgtctctagtagaattgtgatatgactctgttggggagatagggtactgagaagggctatgtgtatgtggagagaagaaagtgaaatccttttcttttatggaagcaaatttagaaagaacacctaagccagttaccccctctctttctggacattct

SEQ ID NO: 100595 - DNA, 238 bp, Homo sapiens
gcggccgcctactactactaaattcgcggccgcgtcgatcctcccctcaatgcaaacttgatttttagtaataaattctagatttgggaaatggccttttataatataaatacaacaaagccatttcacttttacctctccatcaatgaaaaccattttttaaaatgcctgctcatttctgatatagaaaatagattgaaatatagagaactggcccctccaagtgaaaaccgataat

SEQ ID NO: 100596 - DNA, 344 bp, Homo sapiens
ttatttgtaaagatggggttttgtcatgttgcccaggttagtcttgaactcctggcctcacacgatcctcctgccttggcttcccaaagcaccaggattacaggtatgaggcaccatgcccagccttcaattttttatatttaaaatttgtccaagtaactgcataaagctctacttcatttgttttaactgctgtgtagaatcccacagcaggaatatacaattagttatccattctccacctcaacatttagggatcaatttgttgatgttaaaaccaatgctgcaatttccacttctggtcaagatgattcaacagagaccagagatttaccctctcacct

SEQ ID NO: 100597 - DNA, 250 bp, Homo sapiens
ggaaatctctagattgtgacctgcgagggatgtcagagcgtgtgtagctgtgctgtcgtcctgacatggtcggtgacggaagtgctccgttaaggccggctgctgtgattggcgttatccattcttcaagaccagtgtagggcacttgtccaggatctcacagcgagtctggggctggtgcgtgtgtgctggggtacggtggggggcttcgagcacaggcccctctcccctctctcagcaggccccacgg

SEQ ID NO: 100598 - DNA, 242 bp, Homo sapiens
cactctcgctgctctgagacttcaccctccaataaagtgctaacactagctttgcctcagattcggttttcttagtaacttgaatacagacagtaacctcacccaaaccatgccttcaaccaccattgatacactcccaactcactccccaaacttttcctatcttcaatctggacatccctgctgagctccagacccagcaggttccaactgccaaagggacatctctgcttgtacattct

SEQ ID NO: 100599 - DNA, 332 bp, Homo sapiens
cattgctgaaaatctgagtaacagtgtgatactcttttgagtctggcaggacattctctttccagggcatgcaacagtgggtgaataatttcttttcattcatttccattaagggctgaacttccttaatgttctggagattattaaatttgatttgtatagttgtgaaaagtactcatattgctgattccattgcttatatgtgatcatataaatcttttctcttttggtagtgtggtttaaacttaatccttaaagggcatgtatttgaatttttcagctggttagaaacctgaatataccaatcaaataaaactgctccttacatgcta

SEQ ID NO: 100600 - DNA, 501 bp, Homo sapiens
agttctctgcaaagagaggggtttcaccagcagtctcccacctcacaatggagcaccaggactttcacacacaaactgaaaaggctaggctcctccccagcataaggcatgaattcctggtggttccaccagttttcctactatgcatgtgggtgtgcccaagcaaaccataggtagtatcagaaaaggcaacatttgattggttaaaaggcattattcacccaagcaaaccataggtagtatcagaaaaggcaacatttgattggttaaaaggcattattcagaaagaatcaatcgggaaagggtgagccaataggggaagttctccctctgggtcacgggtttcatctgggaccaggagtctggcctttcagcctttagactgttttaggcttgaaggtgggtttcacagggacccttccctatctgcctaggcatctgtctgcctcctgcctctatcactttctcttgagttttatattttagcaacactgagtcatc

SEQ ID NO: 100601 - DNA, 673 bp, Homo sapiens
atccttctgttggtgatttttagttggatctctttgtggtcaaaacactgtatgatttcaattattttaaatttattgagcactgttttgtagcccaggataaggtctatcttgatagttctatgggtgctcataaagaatgtgtactctgatgttgttgagtgggatgttttatagatgtgtattagaacctggctggttgatggtggtgctgagttcctctagatcctcatttattttctgtttaatggttccatcaactgttgagagaagggtgttgaagtctccaactgtaactgtggatttatcaagttctcctttcagttctgccagtttttggttcacatattttgcagctctactgataggaatataaagatttagcactgttacataatgtcttcttgaattgaccctcttgccattatgtagtgtctctcttaatctctggtaactttctttgctctgaaggctactgatagtaatattgacaatccagctttcttttaaataatgtttgcatggcacatgtctttcctcctccttttacattttacttacctgtaatatttgaattcagtttcttgaagacaccagataatttcattatatgtttttaatccactgacggtgcctgtcttttaattggagtgttgatttacatttaatgtaa

SEQ ID NO: 100602 - DNA, 191 bp, Homo sapiens
tgctgggattacaggtgtgagccaccgtgccctgccctggatttgatattttgaaaataccctgaaaaagtaaaactttttattttatttttttgggatggaatttcgcttttgttgtccaggctggagtgctatggcgcaatctcggctcaccacaacctctgcctcccaggttcaagtaactctcctgc

SEQ ID NO: 100603 - DNA, 247 bp, Homo sapiens
agacggattgatgctgttggctggatggagacagcagtgctgtggttacagaggagaatgcccttgtttgcagtaaacgcactgatgccccatacttaccctcaaatggttcaagaaaaagttacctgtgctgtactcataacttttccaatgactgagatattttcaaatttttttagacaataaaatctatcccccccaaaaaaagaaaagacgcccttgtcttctttgcaaccagcattccctc

SEQ ID NO: 100604 - DNA, 303 bp, Homo sapiens
agcggtaagaagactggctggcgacacgattccttttttcccgcccacgtcagctcctagttcctggtaatttatcccatattaaaacttctttaagtaagaatggacaagcatcagcacctgctatgcaaatgcggccaaatccagcccgggccgcggggcgtgcgcgcccgccggaccgcgagcggccattcagcgctcccaaggcgccggctcgacccttcatatggaaacccggcgggtcccgacagattgcggcggggaggggcgggggccagaatgccctcccaacctcggaaggcg

SEQ ID NO: 100605 - DNA, 193 bp, Homo sapiens
atttctcttggatcactgctttaactgcatcctgtaagtgctgatatattgtgttttcattttcttcatctcacagcaatttctaatttcccttacgatttcttctttgacccactggttatttagggtgtgttctaaaatgtctacatatttgtcattttcttcaaatttccttctgttactggcttctaac

SEQ ID NO: 100606 - DNA, 347 bp, Homo sapiens
cgtaggtcctgctgttggagggcgcccactaggactctgagaggtgagacagttggcatcacatgaatggtgagtcagggctggagcaggacttgagccctgagtgtgccgcctgcctgcaggcgcctctggggagctggccacgggcatcctcacgtctgcgcccctggcacagagcacaggcttggccagcagccgtccagaagcggcggggaattgctgagctggaacctgagcgacctccagggcagccccttgctccagtgttgcggttggatccacagcctaggggatagcagccagcggctgcaggaggcccccgcttacccactaagggtgatcttgct

SEQ ID NO: 100607 - DNA, 484 bp, Homo sapiens
tgttctcaaaccaggtagcagggaaggttcccaaactttgttaatataccacttaaagtgtacacactttatgagtgtgaaatttattgtatgtgaattatatgtaaattgaaaaattcaaaaagaggtgttaaaatgaccctttaaaaactcaagttttgtttttaaaagtttgatttggataggaagaagaaagtcctatatacatatttgtgtttacttgaaaaaaaaactacctatctttacaaccccgtccttttcctccatctcttccacaggtgtttggctctgatttctccccttcagtagtatttggtagaatatcctgaaagaaacttgtttcccttgacaagaattttcactaacattcactcacagcattcaatgactgtgcagaagtcccagcacaaataaatgtctcactcattcctttgtgataaaaacccattctgaagcaaagaaaaactgcaccttttcctaaatg

SEQ ID NO: 100608 - DNA, 163 bp, Homo sapiens
ttatgtacatctttatttaacaacatgaacattttcttatgccttccttctttttacatgctgtaacaatactgcataatttgctatctaatggatatgctataaattgtttcacttttctgtactgttgaatgtttaaactccttgggtttttactttggaa

SEQ ID NO: 100609 - DNA, 310 bp, Homo sapiens
cttgtagtcccaccactttgggaggcccaggcaggcagatcacttgagcccaggagtttgagaatagcctggacaacatggcaaaaccctgtctggaaaaattacaaaagttacctgggcagggtagcacgtgcctgtaataccagctacttgggaggctgaagtgggaagattgcttgagcccaggaggtcgaggcttcagtgagtggtgatcatgctactacactccagcccaggtgacagaatgagacccttgtctcaaaaataaagtagttatagagctggaaaatattctaatatagctctcatt

SEQ ID NO: 100610 - DNA, 4290 bp, Homo sapiens
tatatacttgattctaattagtcatcttttacgcaatctctgttgtctcttttctaaatgtgtttagccactcttgaataccattctccactattaacattaatttactcaaaccgttcatagcattctgtaaacatgtattttacatatttgttcccaaatttgcccattgttcattatgggtaactaataataaatttaatgctgtttcaggatgcttttcttataacagtgccactctcaggaattactaagtgacattttaaattgatattttaaactctttccaactacatagttatggtttatttcattctcatcctgttgggatgagaacttgtttgtgcctttcataacttgtttaaagcagagttttaaaattagtttataggatctgaggtggctattagttacagtggcaagattatttagaaagcaagattttgatgagaattaaaaacaatagaaaatgtagagtgcttaaacaaaaatgttatattttgaaagagtagatacttaatttataaataacagtctgaaggttgatgctattttgggataattgttttgctaatggataattctaacaatgcagaatacctagtcaagactgtcatcaaaaacattcacaaatgtttcattctatttttagtgactctgtttaaagagtttctgaaaggaaagaaattttttatttttattatctttagcagtactgagtgtcatagcagaatattttacagactttctatgagattatttttatggtacaaagtatttacatttccctcatgtttatcattatgccaattttacatggcagtcatgccactgactctgctatttagctaagtaatttcttttttcggagactgtctcactctgtctcccaggctggactgcagtggtgcgattctcctgcctcagcctcccgagtagcggggattacaggcacgcgctgccacgccccgccagttttcatatttttagtagagacagggttttgccgtgttggccaggctggtcttgaactcctgacctcaggtgatccacccaccttggcatcccaaagtgctgggattacgagcgtgagtcacagcacccggctaagtaatttctatttattgtgccaaaacatgtcaaaatcatgacctctttgaatggtatatttgagaggatgttcatttcattggttaaccatggactactctgtccacgtagtaaaaacatgcaccagtttttacctattatcatggtagtatcatctgccaaaatttcaaggcattcattttattctttgaacaactcttcaccatggtgtggacatgaattttcatatgtgttacttgactagaagtataaatggtttactatagatatccaaaaaccttgagatttgctcataggaaatgaatattgtgatgaatcctgggctctagagtcagacttgcttgggtttaaattcttgctctaacacttactgtttttgtaaccttgagcaattttaatctctctgtgtctcaatttcctcatcttttaattaggggatggataatactacctacctcacaggatttttatgaggattaaataaatgtaaggtttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtttggtcccaacaaacagcattaacgtcacctgggaacttgttggaaatgcagcctctctcggggcctcatctcagatcagatctactaaatcagatactctaggggcaggggcaggggcaggggctagccagttgtgtttaagcaaactctgcaggtgtctttcttatcctagtttgagaaccaatacccaacaacctacgtgattttggtgcaagtagtgtttgaaacacactgaagattactgccctattactaagacatttttcaaaaagcatgttttaaatcagtgtagtccaggatcacactatattaaatataaagataacttaaaggatcattggatcattcattttggccaaatttttagcttctccaaagtgactaacatcagggcctacaataaaatctgtaattctccaagtttagtaattttatattgaggcaggaagggctcattaagtactaataagtacataatttattaaaaacatacataagtgtcatcaaaaaggtccacaattgttagtaaaaaaaattaaattgaagtagtaaatgctgttttataacatacatttttctgctaattcattctgttttgtgtgacctaataaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggatttaaataatgcataaaataaattgccatgttcaaagttgtttcatctgattatttttaaccaatataaaagttgt

SEQ ID NO: 100611 - DNA, 1110 bp, Homo sapiens
aaattacatctagcattttatttaatcaagggattctttcaagtacagtgcatcaacctggtagtaactatagttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggatttaaataatgcataaaataaattgccatgttcaaagttgtttcatctgattatttttaaccaatataaaagttgt

SEQ ID NO: 100612 - DNA, 1350 bp, Homo sapiens
taaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagccctttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctgggccagtcctggtcctgggctgcactcttgaactgggcgaatgtcttatttaattaccgtgagttgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccgccccctcataccgcctcgtgccagcagcctcgcacaagccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaatgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 100613 - DNA, 1492 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 100614 - DNA, 793 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttcccc

SEQ ID NO: 100615 - DNA, 1942 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcaggtaggtgccgcagaccctgcgggttaagaggtggggtggggggcagtgcttgccaaggccctaaactgggagcgctgggtgaggggaacaacccactttggagggttctctgagagatagatacaccccatatcctgggcccagctcgtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 100616 - DNA, 1452 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 100617 - DNA, 2092 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcaggtaggtgccgcagaccctgcgggttaagaggtggggtggggggcagtgcttgccaaggccctaaactgggagcgctgggtgaggggaacaacccactttggagggttctctgagagatagatacaccccatatcctgggcccagctcgtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 100618 - DNA, 1371 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 100619 - DNA, 1481 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatatgcccccctccctcctcccacgttgttgtctaggcggggtcagcaagcggtccttggcttcaacgcagcagactccgtgagccagtgagagccccgctctttaccgcccggccccagcactcgctagctttcctgacgcctggaactgtgcacctggcgccgtagcggaaaatcaactccaagcagccagtta

SEQ ID NO: 100620 - DNA, 1558 bp, Homo sapiens
gtaggggcatgttcaaggagaaatttatgacaaggtttgagaactaagtgaaaactaatgccatccatgaaaagaaagaagaggtatgagattaggggagaaaagagggagacaaaaataattcagttggcacatgtttagtttcagatgccattaagacttctatcttctatggggcaatgtgcttaaaacatccccctccccccacacgctctctctgtggggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 100621 - DNA, 1642 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 100622 - DNA, 1529 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgtacccaacacacccacccctgaagaaaaaggaaacca

SEQ ID NO: 100623 - DNA, 1331 bp, Homo sapiens
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctg

SEQ ID NO: 100624 - DNA, 4231 bp, Homo sapiens
cagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtcccccccagtccttgcctcccagaatcttacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggtgagaattgcagcagaggaaagggaaaggactcgggagcaggagggagtgatgtggggagaccagtttctccagtaaggtacggcctgtgtgtcgcacagtctcagtgctgcaccctctgggaggaggacccctgggatgccctgtgagcggccctccacactgccctccttgcacttctctcgtggggaaaggtttctgtccctccccagaaccttgtaggactgttctcagttgtacctccagcctgtttcctctgaagtataccccacacttgggccccctctggagcagcccccatcaggtgcacagacgcccctcagagctcagtgcctctgaggctgggccgaaaggtggagaggagcttcctcccgagctgcccctcctttcccaggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctc

SEQ ID NO: 100625 - DNA, 3644 bp, Homo sapiens
cagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtcccccccagtccttgcctcccagaatcttacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaatgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctc

SEQ ID NO: 100626 - DNA, 3837 bp, Homo sapiens
cagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtcccccccagtccttgcctcccagaatcttacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctc

SEQ ID NO: 100627 - DNA, 4289 bp, Homo sapiens
cagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtcccccccagtccttgcctcccagaatcttacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggtgagaattgcagcagaggaaagggaaaggactcgggagcaggagggagtgatgtggggagaccagtttctccagtaaggtacggcctgtgtgtcgcacagtctcagtgctgcaccctctgggaggaggacccctgggatgccctgtgagcggccctccacactgccctccttgcacttctctcgtggggaaaggtttctgtccctccccagaaccttgtaggactgttctcagttgtacctccagcctgtttcctctgaagtataccccacacttgggccccctctggagcagcccccatcaggtgcacagacgcccctcagagctcagtgcctctgaggctgggccgaaaggtggagaggagcttcctcccgagctgcccctcctttcccaggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggtattatgggtgttaaatgcggtgtctgttctgctctgtttgcgatctataaatgtgaggccctcttgaaaaaaaaaatgggttattggggggaaagggaaaggcctgcaagttccgccctttgaaggaatgcggccaagggaag

SEQ ID NO: 100628 - DNA, 305 bp, Homo sapiens
acaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacaggtgaggtcctgggatcagtcaacagggg

SEQ ID NO: 100629 - DNA, 3614 bp, Homo sapiens
cagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtcccccccagtccttgcctcccagaatcttacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccgaagccctcgcgaggcctcctggaggccccgtgctggtggatttggggcaggcggccagttgctttttctctgctggtctccttgtctggtgtttgccctcgccatcttggtcttcgcgttgggggga

SEQ ID NO: 100630 - DNA, 560 bp, Homo sapiens
ctgtgatccggattgaagaggaaactagttcctgctctgggctgagctgaccacgttgggtaccctcccctgtgacatccatggtcctgccctcgagaccctcttccgtctctccttcccaggccccactgccctctggttctcctcccgcctctcctctaccctgcagccaacaggctgcttggcctcctcctttgtgagctcctagtaatgagcagacccaggagctcctggctgggatgcccatcatgtggctcccgccttctctgaacttcttatctgaggcgagcatctccctccgcagctcaactgcagggtccagtgtgggtacccaggcttccaccccttgcataggtcctacccctcagctcactgcatgaaagtatcattgttaggtgactgaggaaggcatggctttgcgcgctgctcctgcctgcctctgatgatagcctgtgtggacggccgcatgtgtctgatgtctgcgtgtgtacgctatcagctgatacgttgcaccagctgtccctccccccaggagatacatgaaggcattacgtgaatga

SEQ ID NO: 100631 - DNA, 291 bp, Homo sapiens
tgaaatttttttgtctatctgaaatgatgcatgcctatgtggtattactatgacaaaaaaaggttcatcttctcagcctggcctacttctgactcttaacttttaatgcagccaaaatactgtatgtttctgtaattaatattgcagaaaacacagcagtgaatgcactaagcaaaacaaaacatttagaaaccaaattaaaaaattttttaattaccttgaatatgggaacctgcacaaacacctgctttaagtacaagtaaaataataatggaaatttgtgatgatctt

SEQ ID NO: 100632 - DNA, 378 bp, Homo sapiens
aaccaagaattccaagagtattccttccaaactatcctattctccatctgagaagtctccccgaaatcttactgattgaggagaagtctccagaaccaagactcttcctactaattagggagagtaaaccgagacccctgaagaagctgaaccaattgggagaaggaaaggggtgttggcagcacctagactactcaccaaatcagacaccccataatggggctgcagctgcagacaatccatgatggggctacaaacagacactgtgataaggttacagttacaggcaccccatggtggagctacagagggacaccttgccatggagctctagttatgagatatctccccaggacaatttctctattgcaaagtgta

SEQ ID NO: 100633 - DNA, 388 bp, Homo sapiens
gaaatattgtacatgagaaaaaaatgctgctcatcagacattttgggtaaatactttagctgatatttagatgtcataatggagcacttatggaacttaaagaggatgctaaaatgatttttgaaagctataagtaacaatcatgcagtcttatatacccttgaaaatattttgctttcaaattttgctttcaaagatagggcacaagttgctaaattctcccctaaaacttttttttttgcttttgcaaagggataagacaataaacaccattggtgacctacctttcttcggttttacagatgtttatatttttaaaaattctttttagaattaggatcttgctctcttgccgaggcagaagtgcagttatgtgatcatagctcgc

SEQ ID NO: 100634 - DNA, 285 bp, Homo sapiens
gtgctaggtgctggggatacggtagtgagcggagcagatgtcctgatgggtgagagacacagagcgagtgatgatgatgaagtggcgtgagtgtgatgctaggaggagcagccgggacacagcctggtctagggtcagagaagcctctacatggaagaggtgtttgatctgagacccaaaggacaaagaggagttaacaaaacataagatgagggagggaggggcttcaggccgacagaacagcaggggaaatgctggggttgagagaacgtgtgatccacccag

SEQ ID NO: 100635 - DNA, 209 bp, Homo sapiens
ctttgaagattttgagtaaaaagtgtgtaatagaatcagaattctccttagcagcaatgagtaagatttaatggaaaagtaatagaaacaggaagaccacagtctttaagaatctcctaggtagatatgtctgatatagaatagtgacggttggaactctgtggaggtgatataatgtgaagggaattacagaggtgaaattggtatta

SEQ ID NO: 100636 - DNA, 367 bp, Homo sapiens
ccatctgctccatttgagactccatctgctccaggcagctgtctgagccttggaggagcagctcacaatgaattgtaggcttctgttgtcccttgctgcctatctgtaagtaataaacccatgaaattccatgtaactcaacgagttccatgtaacttgttgtatgtgggtgttctctctcaccagagtcagataagttgctaaccagtgcacactgaacctgcttcacaaagagtactgtgtaatcatgtcattacacggaataaaaaattatgcaaacaggccaggcgctgtggctcacgcctgtaatcccagcactttgggaggccgaagcaggtggatcacgaggtcaggagttcgagaccag

SEQ ID NO: 100637 - DNA, 492 bp, Homo sapiens
ttttttttggcttttgttaaaagtgagctggaaattgaggcacaaaacacaggctgattcaattctgcaattcagatttgggtcaaatttgcatctttgttttggtggctttagtgtgacttgaaagctgtagtgacaactccacttttcatcttaagggtacagtaaatagttaaacagtagatgtctctcacatgtaccttcagaataaattctattaacattcattcaagcatgacagtcagtatatatcagatatactgtattatagttgacttggtgcatacccataatacatggcatattttacttactttttcatgtattaaagaaccaaaattattaaaatctgagaggggacaagctcagaaaaaaaaaaaatcaacagaagaggaaaagcagtgtctttcccataatagcatgaatagcttgtttgaaacgtaggtagtgaattgaaagagagagatatttgtgcctcaaattagaaatcgg

SEQ ID NO: 100638 - DNA, 433 bp, Homo sapiens
tgaggatgtatgctcctcatgaccggggataaactcatttagtcagcagctgtggcagccacagctgcaaaagcgtaacatttacacagtgctttatcacctgcaaagccctttcatccaccttatctgtttttcacaactgcactgtgagtttggtattactgttatctcatgtgtagatttagaagccactttcctaacttagtgacttactgcacaaaaaagccttcaaccgtgaattgttagagatggtttttagaaagaaatttggcacttttcaataggctatagccaatcagtcatgcttggagatattatgtattttggtttcctacatggacatccaagttcatgaatcttttggaattcttttccataacaacccaggatggcaagctttcgggttaagacaaatgggattatttatttaaga

SEQ ID NO: 100639 - DNA, 126 bp, Homo sapiens
gtattaagcatcagttgtcgattcattcatttcacacatttcactagtgacactgaatactgcagagccaaagatgaaaggggaagcaattccaggctgatgagaagatgcacgattgccattcag

SEQ ID NO: 100640 - DNA, 298 bp, Homo sapiens
ataaacttttaaaggacttctgccttcaccaggagctgcatcccacttcacacatctaggcactgagtgttcccttgggccacaatcaaagagcctctcatggcattcccatcttgcccctgtgggactaaaaaccaagattagaaagctctttgaaagttggaactctgccttatttactctttcttcccagcccctatatggtgcctggaatgcttgttgaataaacaaatctatgcacctagaacaaatattagaaatagacctttaaaatctcccagagtcaaaaatatgtaga

SEQ ID NO: 100641 - DNA, 1071 bp, Homo sapiens
ttgatttccgtgtgttcattgctagtataatatatataaattaattttggtatcctgatcatgtatcctatgatcatgctgaattcgcttattgtctaggcattcatggattggaagacttcacatttttgtgatgacagtactacccaaaccaatctacagttttactgcaatcactatcaaaatccaaacagccttttttttttttgcagaaatcaattcataaattcatatgtaattgtaatggaggcaaatagacaaaatctttcttttttaaaggaacatgatggatggctcccacttccccatttcgaaacttactaccaagctatagtaatggaatagaatttagagtccataaagaaactcatacatctaaagtcacttgattttcaagaaggatccaagattgcttaatggagaaagcatagtctcttcagcaaataatgctgggcaaatatatatacatatgcaacataatgaagttagatccgcacttcacactatacttaaaaattaactcaaaatgatcaatgacctaaatataagaggttaagctatacaactcttagaataaaacataaaggttaatcttcaagactttttatttggaatggattcttagataagacaccatatgcacaagctaaaaaaaccccacataaattggactagagcaaaaaaaaaaatgctatgcatacagagacattgtcaagagcatgaattcttctagtatcagaatatataaagaactcttagaccaggtgaggtggctctcacctataatcccagcactttggaaggctgagatgggtggatcacttgagcccaggagtttgaggcctgcctgggcaacatggcgaaaaccatgtctctacaagaaacaaacaaacaaacaaaaaacaacaacaaaaaacaaaggtagccaggcatagtgacccatgcctgtggtcccagctactcaggaggctgaggcagaaggattgtttgagcctgggaggtcaaggctgcagtggggcgtgatgtaccattgcactccagcctgggcaacaaagagagactctgtttctt

SEQ ID NO: 100642 - DNA, 851 bp, Homo sapiens
cacagtcatctatatttgaagtcgtttgttctagatactttctatttttgctctatattcatttcttttaagttctgttttattggatagaaaatatagttattaagctatcctaaaattttcataagaaaccatgttcctccgcttcagcacattgcttcccacatgattacatatttctttggtttgcaatgtgggatagtttagtggtccccaacttttttgccaccaaggaccagtttcagggaatgtaatttttccacagacagatggggaatggttttgggatgaaaccgttccacctctgatcatcaggcattggattctcatagggagtgcaacctagatccctcgcatgcacagttcacactagggttcacactcctatgagaatccaatgccgccgctgatctgacaggaggtggagctcaggcagtcatgctcactggccctctgctcacctcctggtctgaggtctagttcctaacaggccatcaaccggtaccagtccgtggccaggtggtggggacccctgggatacatcatattttgtggactgcttattcctctaaaactggatacattttctaacttctgcagagcctttactgattttgtagacagcataatgttttctcataatgtgggtgttctatcgtgtattgaataatttcccccaatgtttagcatttaagtttatttctaactgttgcctgtgaagactgtattttcatgaatatctttgtcctcagtgtttttccttgtgaccacttgtgtccttgggtaggcagctgagggtggaatcccccagatgaggagcacgtttccccctgtgacccgggctgccgttg

SEQ ID NO: 100643 - DNA, 262 bp, Homo sapiens
taataaaattaaaactggagttgcatagcttgattagccacagttcaagtgctcagtagccatatggctagtggcttcttcgttgaacagcaaagatatagaacatttccatcatgaagaatgttctattggacagagccggtctaggtaggatttgtagagacttataaaagaacaaattgccccaagccaggtctgtgacaaaaccttttttcatgaggtaatttacagtctccttctgggaagaaattagcattcctgt

SEQ ID NO: 100644 - DNA, 354 bp, Homo sapiens
gtctcatgatagtcttgggacagcaggaggttaaatattaaaatcccatttcacgtgtataagtagggggatgtattttctaaaaaattatatattttttatttttttgtaaaatagagatagggtgtccttatgttgtccaggctggtcttgaacttctgggctcaagagattctcctgccttggcctcccaaagtgctgggattacaggcatgagccactgcgcccagcaaaatttttaacaatctggatattataagcaccaaccaacaagagaatactgaaatcctggtttcttattccctagcatactttccactgcaccacgctatttcttaatacagccatgccttt

SEQ ID NO: 100645 - DNA, 341 bp, Homo sapiens
tgtccagtgggaagtggtcactcaggctgggaagtcaggagggagatgtggggagtcagtgccacagaagtgagaacagaaaccatcagacagaggtgagggcaaaggaagtggacaggaggtaaaagagaagtggggtgaggacaacgccttggggaccccaagcataaggaggaagagagcagagggtgccaggcagtgacagaaggacaaacagagagcatagctatcaacccctgaaagcctcaatttcctcctctgtaaaataggatttttttttttttttgagacggagtttcgctcttgttgcccaggctggagtgcaatggcgcgatctcagc

SEQ ID NO: 100646 - DNA, 609 bp, Homo sapiens
ttactattatcacatacaactaacaaaaatggtgctttattttttgtcattcttcccttgtacagtagtatctcacattcagtacttctttagatcctcataagaaatctgggaattaagtattattcccattttctagataatgaggatcagacttagacaggggcagttaggccgcatagctagaaagtgagtcacatttacttagttttgccatgtgacaggtctttcccctatgtcatctcccttaatcctcacaataatcctggagggtgtgatgactgttctccctttacagatgaggaaggaggctccgtgtgtcatgtgccaaagatcacacagtcggaagcagggtagctggggtttgaagccaggttttccggctccagattcaatcctccttgtgcttcatctactacttctcagtcgaggcaattgtttcccccaaggaatatttggcaatgtcaggagacagtcttggttttcacaactggaagggggctgctggcatgtagtgggtagaggccagagactctgctaaacagcctacaatacaaggacagcccactcctgccagtaaagaattatccaacttgatacgcaatagtg

SEQ ID NO: 100647 - DNA, 265 bp, Homo sapiens
ctactccttcccattcaagtatgttactttattcctaaaccactgcaaaaacctccattggccttccattttctacttcaaattaagtatgccttaaaataaattctaattgggaatatacatggagacctaaaatacagaatgtgcatatcagtttaagttcccatcccccttctttcggtatcatctggataatgttgtcctctggctcaaactctcaatggcttaccactgccaagaggataacaggttacagcttagcctt

SEQ ID NO: 100648 - DNA, 268 bp, Homo sapiens
tctgttcttgcctttattatttccttccttcaacttattttgggttaattttactcttctttttctggcttcataaaatggaagtttagttcattggtgtagactgttgaagacaaatcatgatctctcatgtttctgcacatcttgcaagaagcagcactgactgccttggttctacactatctttttgaaaataaacgtagggaaaaccaccttgaaagataaagatagcgaatcccaccagagcaaaaggcaggtgtgtccactg

SEQ ID NO: 100649 - DNA, 623 bp, Homo sapiens
gcacaggctggtctcgaactcctgagctcaagtgatccacctgcctcgcctcccaaagtgttgggattactggtgtgagccaccatgccctcgtatcctaatttttatgatctaatgggtagtagtgggttgagctgaaaaattgttatgctttaaaaaattcaagaactgtaagtcattggagatcaaaatacactacttttattaagcatttgaactaatagttcatgaatacaatttgatgggcacctcgtaaactcaagagttattcttctttcttttaacttacttcatgaagatacttggctctatgatgataaaactccgcacaagaagggtcattttatttagctgaccatggcccttttcttcttatatttgtacagtccctgttttttcttccttggttttctgatctgggtagaaaatctgctgcctgctataccctcacctttacccttactctcttggcctgtcagaagaattctagggaagatagtcttatggtcccaagagattgtggttgtgtagattgagagtggtaagatcaggaaccaatgcaaatgtctgggctttaccatatacctctgtaacaaaacaggtattctttttgccaagagcag

SEQ ID NO: 100650 - DNA, 441 bp, Homo sapiens
atatcgagctcggtaccttcccaccagcaagcccaattagaggataataaaaatgtcacaaggcagttctattcttgtggaccccggtggatcattcctgaatttcttgccaccaggcaggaccccgcagtctcctaatggatgtggaatgctaaactaagttgcttagaaggctggatcattcaactggccctgctgttagctctgaagctgcctcccagtattctccctaagatgtgctcacccaccctggagagggccagctacacacagatgccaccaagcaaagtgcaaatcatgagataggatgtgcccaccagaaacttcctttgggtaattccagaaacccacaatctccaagaggagatctttccattggaaaagaagaccctgggggtggtctttcttgtctgcacaaggggacagccacaaagagtagca

SEQ ID NO: 100651 - DNA, 721 bp, Homo sapiens
ggtcggccgctgcagaagggcagtcaccccatgtgcaaggagcacgaagatgagaaaatcaacatctactgtctcacgtgtgaggtgcccacctgctccatgtgcaaggtgtttgggatccacaaggcctgcgaggtggccccattgcagagtgtcttccagggacaaaagactgaactgaataactgtatctccatgctggtggcggggaatgaccgtgtgcagaccatcatcactcagctggaggattcccgtcgagtgaccaaggagaacagtcaccaggtaaaggaagagctgagccagaagtttgacacgttgtatgccatcctggatgagaagaaaagtgagttgctgcagcggatcacgcaggagcaggagaaaaagcttagcttcatcgaggccctcatccagcagtaccaggagcagctggacaagtccacaaagctggtggaaactgccatccagtccctggacgagcctgggggagccaccttcctcttgactgccaagcaactcatcaaaagcattgtggaagcttccaagggctgccagctggggaagacagagcagggctttgagaacatggacttctttactttggatttagagcacatagcagacgccctgagagccattgactttgggacagatgaggaagaggaagaaggcattggcagaagaggatcaggaggaggaagagtgcaaagaaaggaaggaagaa

SEQ ID NO: 100652 - DNA, 1009 bp, Homo sapiens
gtatagttcctgcagaaggtatgcagggaaacagaaaatgtatgaaaaaacctccctaaataaaagacatctgagactctaattcaaatgaaaaaaacaaaaaaaaaaaatgtcctggacgcatgtatcccaaactattatggccaattactttgggagcacgtaccacatttgggctgcggggacctaggcaggcagaactaccattcgggtactcctcagacaattttcacatattcacttgggtaatttacaaacctacaacaattccttcaactactctcactatctaacaacgtgctaattcggctttcctaattaaagaaaaaggagatcttcccagttttaaacaatgggtggtgttgtacgaacgcaaagctgggtttcagactccccacacacctctggtagacacatctcaagacaccacaagccaacggaaaatttctccactaagccaaccacttgtgaacatttcaacacacttgcaggcattcaaacggggctccactagggaccccaccagtagacaagctgacaaacatatttcctacggacacagctagatcaggacgacattcagacacttcttcacgacatcctggtgcaaccaccccttatacccgccaaataaagttcttcccgtggcacacaccaaaaagttctgctataaggcaacacgatatttaacccctacatttccacccaaagcttgtcctatacccgctggggatacaaaaccccttggaaccatctacacagggatggagatcaagaccacaaagattttcactccccacccgcgttcatagaggagagatccatcgttagtgcagaatgcaaaagactcctggaaccgtgacccgcattaatgtggcccgccggagacaccccaatcttggtgacattggctcaacaaggggcgaatacacagtaattccctcttcagggacttgtgggccaatagcgcaccaactgagtcaaggcaaatctgcctgcgcccccccca

SEQ ID NO: 100653 - DNA, 434 bp, Homo sapiens
  misc_feature (2)..(2): n is a, c, g, or t
tncagagtctcgctctgttgcccaggccggagtgcagtggcgtgatctcggctcacttcaagctccactataatgtgagctctatgaaagcaggaacagtataagtcttagttactgctatagttcttggcacaaagtactcaaataatgactgaatgtagaaggtactctcctaaaacacatacttctttgagtcaagtaagaacctctgtctatgtgtaaaagggctctctaaatttgggaacactgccacgtatttctagatctagtatatgagccattgtcagatgtacatcctattccagttttgagccattactggctgcctttgggtgagtttgcttttcattctaatttcagaagccagccacctgccattatctaaaatcctgtccacatcaagtttacacagtaagcaattcataaagctgtga

SEQ ID NO: 100654 - DNA, 414 bp, Homo sapiens
gattcccaaatcaccagagcctactgtaaactggcctatggcagatgctcaatcaatgaatgttgtactaccctaaagtaccacactagaggcaatcacagggtgctatgtgcacccacaggagggacacctaaactcagcttggagagcaggtgagtccaagacaacatgcatcaaagaggctgagatggagcatccaggctgatgagaggagaagtggagcctaggcagatgggccggtgagaagtccagcatgtccaggtgagcaaaccagggctgcttcaagaagggaaggcagataggcatggctggggacaaaggaagtcagcctgtgaaggggcaaggtaatcacatctggatttgttagagaattggaattttactttgaagatagtggggagctactgcaggatt

SEQ ID NO: 100655 - DNA, 798 bp, Homo sapiens
agacgttccaagaaatactctctattctttacattttagaaatgaaagggttaatgcaacctctacttcgtaggcactcacaaatgatctgagggtcatttttgcctgattctaaccctcttctgcctgcctcaacttggctgttcctcctacttgacttaaaaatctcattccattaacgtcaatcctccaggttagaccactaaagccgggtcgcggtctctagaagctcactgctgctatgcacatatgttacctggcaggagaagaagagcccctgattaggaggtaggggaaggacagccatcttctgtagtcctctttcattagcacattagcatgaatgagcttatcagattagctaattgtcacctggacactttggacagtgcagagatactggtgaggcatatttccacaaaaagcagagggaaaagcacagcaaatgacaagtcctggaagggctatggagcatcctggaagggcagggttcaatgaggaaggacaaacaagatgctccagaggactggagaggtaggagagaaagctctggatgagaaggcgctaaagatgaattttaccattttcaagctttgctttgcccaggcatttgcctgtttcctgctggagggatagcagatacacaaagcagctcaggcacaagggataacttgactcctgtttcttgaaagcgtaacaggagcaaagacaagtgctgttaagatggaaaactagataacctgcaattcctcctcctataaacacctagaaaaactagataaacatacaaatattttt

SEQ ID NO: 100656 - DNA, 410 bp, Homo sapiens
ctgaggagcggttttctggggtctgtaggaagacagttctaattaggatggaggaattatactagggagtagagggaatggaagtgagaagaattagtaaagagaagaaatgtgaacttatcaaataggccagagtaggcctctgaagattcttgagtaagtgagtgaactagattttaggaaggtaatgagacaatcatatgcaaggaagatttcaaatactagagacaagaagtcaagcaggacttcgagcagttgttgaggtctatgggaatggataaaatgacacaagtgagagatgttaagaaaggatcaaaagactttcatagtgtattgaatctgggaaacaaatgagcagaggctgggaataatcacatctaagagacagtggggtacagacccgcatgcag

SEQ ID NO: 100657 - DNA, 96 bp, Homo sapiens
ctgtaggaagaggaagacagagctcttaccagggggaggcagagatggcacagcaagagacatgcccccagaatgccaccaatgccccaggacagg

SEQ ID NO: 100658 - DNA, 203 bp, Homo sapiens
ctcaagagacagaaagagatattcctactgcaaggattttgctcaatctcttcctctctgctctttcactacagcttaatcaggattgtcaaataggttgtttcccatatattccacacatcaattctaacctattagtaatcactatctagagaatgaaggaaaagtttctgaggccaaaatgtgtgaggagaagaaggggt

SEQ ID NO: 100659 - DNA, 221 bp, Homo sapiens
gcgtcgaccaattatagcatcaaaactggcaatgctgatgaagctgtttgagagcatgccctctttccaattctgtgtctatgtccatgaccaaggaagccctgtattatttgcacccagacctgcccaagtcatcattcatgtcagagatgtgaatgattcccctcccagattctcagaacagatatatgaggtagcaatagtcgggcctatccatccag

SEQ ID NO: 100660 - DNA, 765 bp, Homo sapiens
caaaagcagcatgcaacccttatgaacccatcttggaaggcattcggggagcccaagacaagaccattgggagcctcagggtcacttgtgggggtctctgtgctggacggctgtacctctcatgaaatggacaactgaccataagaaggaggtaagttacgcatggacgggaaaataagaagctcctacttagggctgtgatatgtgcggtaaccatttaacgttaatagcatccatgtgagacaggtgctagtactgccccatttcatattggcggacattgaggcacacagactgtatgacttgcccaaggctgcccacctggttaggggagctccaggattccaatccagtccgaactcaacacgaggggtggcacctacaggctggggtcaatctggaagactgcctgttgtatggcctggcaactaaaaaatgttttttacatttttaaatggttgacaaaattaaaataagagaatatttcatgacatcatcaaattacacgaaatgcaaatttcagcatctacaaatacagtttgattgggacacagccaccctcatccgtttgcaggctatccctggctgcttacagggtccacatagtccataaagcctgagatatttactatctggccttttacagaaaaagtccccaaacactaatctgaaatgtttgcatcagaaccccttgtggggcttgttagaatgcagctccctggtcccacacccagtctctgattcagtaagtctggagcagggcct

SEQ ID NO: 100661 - DNA, 838 bp, Homo sapiens
cctttgttctcttccagactttaaacaagtgagtcctttccttccaatctaagtatggagtacaatggaacagtagagctgcactgaagacaagacttcttgggctaccatttttctggaagtttctacaaagtctgttatttatcattcggacagactgtgacaaatgccattttaattcaatgatatgattaaataaaggtttactgattgtttcatttcctgtatagttctataatttgatataatcccatgtggggttttttttgcttttgttgcttatgcttttggtgtcatgcccagaggaatgtcattgaggtttccctctgtttttccccagtaattctttgggttcaggtcttatgtttacatctttattacattttgaggggttttttttgtatatggtatcagataaaggtccaatttcattcctttgtatgtgaatattcatttttccaaacaccttttattgaatagattattctttttccattgtacgtttcttgacatccatgtgaaagggctctctattgtattctatttgtctttatgtctatttttatgtgattaccatgccattttgattactgtaactttgaaatatattttgaaatcagggagtgaggcttcccattttgatctttttactcaagattgctttggctatttaagatcatttgtggtccaatatgaattttaggattgttttttctaattgtgtaaagaatgccattgggatttaggtagggattgcattgactctgtagatctctttgggtagtataaacattttaacaatttaattcttccaattcaaaagggatgtcattctatt

SEQ ID NO: 100662 - DNA, 592 bp, Homo sapiens
aaatttgaaaatagcattaccttcccctcagaaatcacttccacagattgctgtaaccaggaaaatatattttattagtagcataacaatttgtctgggtcttttaacttattgtgaagaacagttctttttccatccaccactgaccagtttttttcagatgagggcctgttaccatgctctcaaagataattatttttctaggtaagtcccattgggaataattcttatgaccttgtagataagcaaagagacttaattgacaagcagacacttaacaatttatgatcactgctcaaaatgctttttgagcataatctttggcaggttcattcattagatgatggcattgctgacaaaaggatattgtggtggtttaggttagagccatttaggttcattcttttcttccacctcagctatacagatgttttctgtgcttcttgggcaatccagtaagagcccatggatgggttggtacagttcagcccacatttggaaaaaaattttaggcagttttaaaatatcttttaaaaaattgcagctcatagtaagagatacattttacattataacctaatatatatgcaaa

SEQ ID NO: 100663 - DNA, 443 bp, Homo sapiens
ccttctagaatctcagcttcttaaatcaagaaattgtgtcttgttcatgtctgaattccccaagtgaacacagtgagtgggtgcttgacaaatctttgttggtaatgagcaaaaaaggggattctgtgcccaataccatgaaatcaatgcacagaagattcaatcaatcaagaaaggtgcacagacgctggccacacacactgacatttgttttcagatgttccagtccccctgacttccaccaacccattcattcattccacaagcatttttgctggggtggaagcagggccatacagggtgtgtaagtaacagatagggtgggtttgtataatgagtataaaaaacttctagcagaagatgacaaagtatatcaagaaagggctctcttcgaaatcacaccactgcactccagcctgggtaacagagggagattccatcta

SEQ ID NO: 100664 - DNA, 247 bp, Homo sapiens
  misc_feature (13)..(13): n is a, c, g, or t
ctagaggatcctnccctggtatcccacccctcagaggctcctccagccaacctgcacaaacgattccctcctcactgcccggcacacggcaccacctgatacatggctgttgtcatccccacaacaggggtcccaggcctgctctgtcacctgctcacagactctggcaaagctctgagggcagcaagggaaggccagtgagaaaggggcggcagtgggacccaggtgtgtcagagtagcccagggg

SEQ ID NO: 100665 - DNA, 408 bp, Homo sapiens
cgctgtctcaaaaaataaataaataaataaataaaaatataaagttacaggcacctcaaggttgcctgttttttgcctactgttgcttcagttatgtactctcagtgatctgttaccttcctttccagaaactctgtgtaaatatatcttaattcaatgaacaaagccataatggagacattggaggcattagtagccagccagtgatctgttgttttgttcattcaagaggaggttatcatgaaaatactctgtgagaaacagagttccaggattacactggcttaaacaatatggaagtttgtttctcttatgtagtagtcccaagatacatagttcagggctgctgaaccatctgctgtgcaaagtagctctatgccacaaaatcttcaagacccagcaatttct

SEQ ID NO: 100666 - DNA, 225 bp, Homo sapiens
aaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctggg

SEQ ID NO: 100667 - DNA, 382 bp, Homo sapiens
ataatgtgtaccttcaaggaagcacaaacttgttcttggtgttaatgtatgacatgcaattctgcacccaaattatgtaatgctcctcattgaggcagaagtcttcaaatgggactgctcacctagtcctgccttctacagttgtgaccctaatagtcaggtagtgtccatcccatgtgcctatatgtaacaatatagagagtgtttctttaactctaggactttgtgaagatgagaaaatgtttgagaaggattgaacctcacactcagtagcagaatatttggttgaacttacaccattcatgtttttcaaggtcaaaaaaaaaatagtcaacagcagcaatttcacatgttcaacctatccctgcaagctcccatttga

SEQ ID NO: 100668 - DNA, 854 bp, Homo sapiens
acgcgccttgtgcacccccaacgagcacttccgcttcccgcagctccagcggccggccgggaacttcgctggagcagcagagttccggagcgcggcgaaggctcccacgccgcgggagggaggaaaggcgtccgcgggacggtggaggcaggcggcggggcaggcctggggagttacacccgctccgcacagcgccctgggctccgggcgcctctccgcaccgggcaggagttttggcgggagggattctggcccggccctcccactttctctgcccctcggaggcaggtggcagcacaggaccgcgtccaggccgaaggacagcggggctggctaccgtgggcagagaaacgtgtcggggacccgggttagcagccctgcaaaacaggcacccgctgatggccggtacgtcctgaatgttgcggtccgatggccggtacgtcctgaatgttggtttactttcccggaagttagggtcagagtcctaactaagaacactgtcccattcctctgttcactgtttgcctgggccattcatgtccacatacaacttcactcagaaagctgtttttgttgttgttgttgttgttgttgttgtttgagacggagtctcgctctgttgcccaggctggaggctgggcgctataacggttcactgcaagctccgcctcccgggttcacgcccttctcctgcctcagcctcccagctactcaggaggcctgaggcagaagaatcgcttgaaccaggcaggtggagggttgcgccagtgcgctccagcgtgggtgacacagcgagactcagtctcagagaaacgcggacaaccaaatttcggggcaaggggcgggggggccag

SEQ ID NO: 100669 - DNA, 600 bp, Homo sapiens
gaagaggaactctgaagtggacattaaggaatgtgagttttatcattaacagtctgattattagagtggttatttggcaaattgtgtaatgtgttcttgttttaaggaattctctatcatctagattcacagataggatttgtaagtaattgctattaaatagctaacttaatatcctgtgcaagggcatctaatgcccagcagtagagaagtttctaattggacaggccagtgagatacattgggtagtatctggagccactggtgttactttagataatacctacttaggtactacatttccaccataacacctcgtctctagcattaagctgtcctgagacacttcagtggtaaatttcatttagcttttatctcagttggaaaaatagcctttctccaagttagtagagtatacttaggctgatcttaggtgttaacaaaagatttcctaaagtttactcttaggagtatttgcattttaaaggaaatttagaatgtatgtggttgatatatttagatagtgttagtctttctgtgtaggctttaattacttctgactttgtatgacagtgccaaaagagcatgacctactattgg

SEQ ID NO: 100670 - DNA, 249 bp, Homo sapiens
acagagctggaagataatgcaggttcccaggaggtaggatgacaaggacaaaggagggcaggcctgaactattcaggggacgagctctgggctgttctgaatcgcagatgccatcctgaattgcatttgtgtcaaataggctgcagtggttcatgcatacctttgcttctgtttggcacacaccgtctgaacctcaggcatttcttaagactttaccaaaaccattcagttttcttattgtaaaatcga

SEQ ID NO: 100671 - DNA, 519 bp, Homo sapiens
cctctggaccctaagtgattctcctgcctaagcctcctgagtagctaggactacaggtgtgcaccaccacacccggctaatttttgtatttatagtagagatggggttttaccatgttggccaggctggtctcgaactcctgaccttgtgatccacccgcctcggcctcccaaagtgctgggattacagacatgagcctccgtgcccgccaacaatctattaatgagagtgcagtcctcctctcctgcagagatttgtccactggggcccagagaccagagaggctacgcttccaactggatacaacagaaaaggttcttgggaatacatggtgtcttgagctgggtcatgaaggccacatagtagtcaaggagttccaagtggagagtcctgatgggcaaaagtttggaggcagacagagggttctgtgagcagccagcaggacagttagggcagtggatgtggggttgcaatagaagaaaaggcttaagggtggttgatgtggaccgtgggctgcag

SEQ ID NO: 100672 - DNA, 349 bp, Homo sapiens
ctctgtgttaattgttgagtggaagaaaactggctacttgaatgttccaggtagttgcttctggttcatctaagttttactgttactacaaagtgttttttctcacattgtaattgtgacctatgttggcagcacaaactgtagtctaatatgccagtgctgctgggctacagaaatgccatgtctagcacggtctcctggagacataaggtagccaggacctgtggaatgagagctaatgttaggtctgtctgaatgagattctgtgcctgcctttctgttgtggaaaaggggctgccacgaaaattctctaagctcccttctagtctcctgggtctctaccaagttt

SEQ ID NO: 100673 - DNA, 518 bp, Homo sapiens
cctcctgggttcaagcgatttccctacctcagccccccaggtagctgggattacaggtgcacaccaccacgcccagctaattttttttgtatttttataaatataaaaaagatttcaccatgttggccaggctggtctcaaactcctgatctcaggtgatccacctgccttggcctcccaaagtgctgggattacaagcatgagccaccacacttggcctgatttaatatcttaagtcacctttgcctgacacttagcaagaaaaactaccaagaaatatctaatattttccttttgtttgggaataagaatctactcacaatggacacttgctggcttgttttaaaaccaagcttgcttctcactggcctgtttaagtggaaatgaagtctcagtgtggggtccgatgcttcctatggctgcatggaggaaaggagtctgggcctgaatctcccgtgttcctcatgcatgggtagaactaaagcctcttcttctgtaatgtggcagttcccattctc

SEQ ID NO: 100674 - DNA, 894 bp, Homo sapiens
gaatgcgttcctttcccagggtattaatattaatattccttgctaggaaaataatttagcaatatctctcctacttgcacgtccgtttataggctctctgcaagaagaaaaatatggctctttttgtccgacccctcaggcagtcagaccttatggttgtcttcccttgttccctaaaatcgctgtttttctgttgtttttcaaggtgcgccgatttcatattgttcaaacacagttttacaatcaatttgtacagttaacacaattatctcagtggtcctgaggtgatgtacatcctcagcttacgaagataacaggattaagagattaaagacaggcataagaaattataaaagtattatttgggaactgataaatgtccatattaaaatgaaatcttcacaatttatgttcctctgccacagctccagctggtccctccattcggggtccctgacttcccacaacagttttaggatggtagaattgcaatgcagggcaggtactggagagttagttaaatgttattggttgcagttcaggttatctaagcagtggtggaagaggctaacatggtaggttggggccagattgtggagacagctttgagtgtcacatctaaggaagttagattttatatacatagtggggaatgagtcagggttttgaagtattctataaagtagattggagggatccaagtctggaggtgattaggccacttaaaaagctcttccagaaggtgagataagtgatatgagggtctcgtttgtaaagaagacagcagcaatggcacaaagtcgacttgttttttgatcatttgcatcttcattataaaggaagtccagagaatgtatggctatgtcacattttgggcaatctctctgggctaac

SEQ ID NO: 100675 - DNA, 313 bp, Homo sapiens
ccatcaacttgtcatttacattaggtatttctccttatgctatccctcccccatgcccccaacccccgacaggccccgtgtgtgatcttcccctccctgtgtccacgtgttctcattgttcaactcccacttatgagtgagaacatgcagtgtttggttttctcttcttgtgttactttgctgaaaatatgacaccaaaagcataagcaactaaagaaaaaatagacaagttagatttcagtgagattaaaaagttttgtgttgcaaacagtaccattgagaaaatgaaaagacagaccacagaatgggagaa

SEQ ID NO: 100676 - DNA, 529 bp, Homo sapiens
tttttttttttggtctttgctatttttatatcactgcggtagcataaccctgcaccaagtacaagacagtattgcagtttgtgttgaatgtaaaactgttattaaatgaaagctaataaagcaaattcttggaaagaaggaaattgtctacattcaagacttaaaatattaaaatcaaatttgtcttctaaaaattaaaatatgaaaggactaaatgaaactgtatatttccccctcttcaaaagtcatgacttcatgtagtcaaggaccaaaatctgattagtcactcgtattaattatttttcactgttgcataaattctgtaaaagtgttcctttctcatatatcatctttgtctcttaaaactgtccttactgtgtttttggatttttgtccttttcatcagaagtcacagaaagcttttatggctgaatagttcaacctcacctaggtaaagtgccattgtatctttctaatccatatgtttcctgagcagttatgactcttgtaattttataattatatttaa

SEQ ID NO: 100677 - DNA, 165 bp, Homo sapiens
gaacgtttctggaagaaatgtcagttagtggtggatagatcgtgtcaaaggtgtgggttgctgcttatggaatggtggttctctggcccaggatgagagaattcaagtgccccagacatgcagattcctgcatatgtgcctcaagtcttttgggtcataagtcag

SEQ ID NO: 100678 - DNA, 197 bp, Homo sapiens
ctgccaataaatattctacaacatgattcttcatcaggctttgacagcagacacggtggatttctgggtggcacaacattttcaaaataccactctgcatcacggaatcagccgtgctggccgggcgcggtggctcacgcctgtaatcccacaactttgggaggctgaggcgggcggatcatgaggtcaggagatcg

SEQ ID NO: 100679 - DNA, 736 bp, Homo sapiens
tcctcagacagtctcttggtgaactttgcattagggtgtgtgggtgcagggcaaaagcccagctgtcaaggagagagtcactcattcaggatattctcctcccagttggaacggccttctttcccctcttctctgacctggggagctggtgttactcaggctctgctctggcctctctgacaagccacggcttttataggagcgctcttctccaggcagattgagttctttctctggaaaatagtacttggatttaattttgagtgcaaacatgactggtccctgcagctgagggattgcaaaggaggaaaagggtctcaacatctgctcaagtaaatacctgcattagacagaacagactaccctgccgaggaacaaattcaacctggccacctctgtggcttcatatcaagggcttatttctcactcatttaaattctgatgcagttttccgggaagcggtggcccatgcagacgcagagatctagttggctccatctcgtggctctgccatgacaacccagggcctcactgttgcagctgtgggagggtgagggggactcaggctcactcttctgtgcctcagcatgactggcacatggatgctggaatcacctctcctcacgccctgctgcacagaagcagtcacatggtcctcccttgtagcatggctaggaggagttttctccccatgtgcccatgaggaagaggaatttccatgcggcttagcacagaa

SEQ ID NO: 100680 - DNA, 425 bp, Homo sapiens
tggagaatagtggggctgacatctctgcgattcttctagctgtttctccatgctatttgtcttaaagttcacaaaaatggctacagtattttatatcatatccacattcaaaacagatgaaggtgatggtggcaggaggagtggggtgggagatttcagtgtaagtaatttccatccctctatcaacaaaagcaaaagtgtttgctgagtccatgtcagacatctgtttacttctctgtgctgaaaatgatgacatataatcatataaggaaaggtgggaaaatgaggaccttacctcaggcaggacaaacagctggcccttcagcgagggctttcttagggaggaagaggggctaaatgtcatctaggtcactaatattggctgctacaatatgcctcatactgtcttatcagcttcaatccac

SEQ ID NO: 100681 - DNA, 121 bp, Homo sapiens
atcaggttcaagttccccattctctgcaggtctttctcccttagagctatctccctactcctaccttaccttcctattatgatttggcagtgaatcctgtatcacctggctgacagatctt

SEQ ID NO: 100682 - DNA, 261 bp, Homo sapiens
atttctcatctctgatgtttatagtgcacttaaaatgttccaggcatctaatgcttcctgtgtattgcatttaattcttacccccatgaggtaggtgccatcattaaaacctgatttaaggatgagaggcttgaagcttagctgaagttacacagctagtcagtgatgagccaggatttgtactcagatttgaatgacttcagaggccacatttttttttttttttttttttttgagacagggtcttactctgtcgcccag

SEQ ID NO: 100683 - DNA, 80 bp, Homo sapiens
gagccccttgaagacatctgagagttcacgccacaggctgtgtttgagcacagggctctgcctgggtgggccagatggag

SEQ ID NO: 100684 - DNA, 223 bp, Homo sapiens
aattccagtcgttaagtaggtaagtctaaacaacatattagtggtcatttgtgaggtgtttgataggtggggctgtatttctctcaaacatttaaaatatcccacagcaaccttgtgagtttgttccctgtggtgtcccagggtgacctgatgggaaatttgagaaccatggcataggtcgctaaagatttttcatctggtgaattaaatatttgattttgta

SEQ ID NO: 100685 - DNA, 338 bp, Homo sapiens
cccagccagggaagcttctcaggccgggattcactgagctatagttggagggcagagatatggaacctctgcccagggccagtgttctcgatcgaagcaccgggagctgtctccccacgccccactgtggcacttggcggctgtccagagacaggcagctctcaccaaggcggcgcagacgtgggcctggtgccccatggctgcactgagccatcatgctgtatgcccgggaagtgggcttggcgacagcagtgaagggctgcagttcctggccgccaccagcaccctgaccctggggctctgccacagagccacgcctggggtggagggtgagctgg

SEQ ID NO: 100686 - DNA, 165 bp, Homo sapiens
ttctacttccagtcttgcaatacccttgccattttccaaacaaaggcttattggcgtcatcctttagggtatgcctgctctgaagtaccagttttggagacgtgttttttgcttgctttgtcaaaatctataacctgatcatagtgattgtctcttagcccttcc

SEQ ID NO: 100687 - DNA, 347 bp, Homo sapiens
ctagactaagctgggctgtaataacaaacatgactgaaatttctgtgacttcatacataatttttttttttctttcccacacaaatgtcacactggatgcattggctttctaggacatcttccttttaagcagtgactcgggaatcgaggccacttccatcctgtaacgacgccatctggagcatgtggcttccaggggagcagtggctgaggccctgcagtggcttctcactgctacagtccagagttgcacacagcacttctgctcatagtccatcagccaggagctagtcatgtggccacctcgctgcaaggatccaggaaggcagagtgcgggtgagcactag

SEQ ID NO: 100688 - DNA, 706 bp, Homo sapiens
tgtcgcacggagttgacatatagctgacaaggcctcgaggtagcgtgggtcggtgtagtgtcctgttatgcttcggggatatctactggccttgtagattagttagaaagaatttcctcctcttctgtttttttgaaatagtttcagaagaattggtgttagtttttacttataagttaggtagaattcagcagtacagccatctctggtcctgggcttttctttgttgggagactttttattactgattcaatctcattactcattataaatctgttcgggtgttttatttctttctggttcaatctgggtaatttgtacatgtccaagaatttatccattttctttaggtttttcaatttgttagcctatagttgttcataatagtctctaatgatcctttatgttcctgtaacatcagttgtaatgtctctttttttgtttctgattttattttttagagtcttttctcttttttccttggttagtgtggctaatggttcattgattttatcttttcaaaaaaaacaaattttgtttcattgatcctatttttttagtctctattttattaagttctctgatttttattatttatcttttcctactaattttggtgttttttcttgcttttatatttccttgaggggtattactaggttgttgatttgaaatcttttttttaatgtagatatttattagtata

SEQ ID NO: 100689 - DNA, 991 bp, Homo sapiens
caggattttgttatctatttgggatccccagagattccatatgaatggatgaagttttgctctgtccccaagctggaatgcagtggtgcaatcttggttcactgcaacctctgcctcccaggttcaagcgattctcctgtctcagcctcctgagtagctgggattacaggtgcatgccaccatgcccagctaatttttatatttttagtagagactgggtttcaccatgttggccaggctggtctcgaactcccgacctcaggtgatccgactgcctcagcctcccaaagtgctgggattacaagcatgagccactgcgcccagacttaatgatcattctttaacagccctttcttgatttgtgtgtttgtatgtgtgtgtgtgtgtgcgtgggtgtgaatgtaatgcatgtagtggaggtgtttcttatatattatttttccttttccttttttcttatgtctattactactccattttataacatttatattctatattagcaaaattgttatctcaaatttaatgtttgtaaggttcttgtcactaaccaatctatctttatagtttctctgtcagcagtttttttttataacagagttatttacttttttattcatgcttcttttcattcatcatcttttggtgtgtttctctctgtagtggatatcatgtttgctcatcgtttgaaatgtcttgttatatataacatttgtaagaaacatgttgaaattttatgctcacattttcaagctgcatttcaagctctttctcttggtctgtaataatcaatttataaggttatttcattcacaaactaaacttaaaaaattctgatatggcatgcttgttcatttgtatgtctggattctggtcatacttactctttatttttatttgtacacataaattatacttcatgaatatatattttcattcattaagaataaataaaacattaataaatcagcattctcttactttcaaagga

SEQ ID NO: 100690 - DNA, 302 bp, Homo sapiens
taatttttgtattttgggtagagacgaggtttcaccatgttggccagactggtctcgaacacctgacctcaggtgatccacctgccttggcctcccaaaatgctgagattacagccaccacacacagcccaaaaaatctttgttcggtgggcaaccttcgtctgtgtgtgttctgcactcatgggtgttccctcccacccccatggtcaagttagaatgtgcacagaatagtgtccacccagggtcttaagggctatgtggtgaagtgaacctgaacttctccagcctggttccactttcca

SEQ ID NO: 100691 - DNA, 310 bp, Homo sapiens
gagagaaaatctgatgatgcaagagtgagagggaaggattactggaataatgtccctgagagggcaagaagggaatcccgtctataagtggagggattggccatagctgtagggactgttccttcttagaagtaagagggaagccagcatattgggacacagatgaaattagttcagtagatttgataggagattgcggaagctttttcttgattggttttcattcaccagtgaaatggaaagcaaggcattagctaagattgaagagggaaatgggatccgaagtgaggagaaaggggtgagacactca

SEQ ID NO: 100692 - DNA, 464 bp, Homo sapiens
ccccaaaattactccacccacaatcttccccaactcagtaaatagcaaccaatcttccacacattgtagaagttcattgtctgtcttctccacaagaatgtaatatccatgagcgcaggactcactgctgaatcaccagggcagtgatacagcaacaggagaggtcttgaactcctggcctcaagtgatctgcccacttcagcctcccaaagtgctgggattataggcatgagccaccacacgcagccctccagctcttttaaataagcatcctccatgaagaatttctgcaaatcatcaagctgttaaatgctatatgctgaatgtacacaagcccctaccagtctgagagtcctgtgtaaataattttctctttcaaatcctgatgaaaaagggactcaaagagaatccaaaccacagcctgcaggcttcctcatgcttctgcttcactactgagccagcca

SEQ ID NO: 100693 - DNA, 2734 bp, Homo sapiens
ggcccagccggggagggaggaaggaggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccaccagaacctcaagtcccccaccagggctgcactgggcggtggggacggagccaggatggtgggggcagggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatccctcaaggctgggtgtggaggctcacacctgtaatctcagcattttgggaggccaagtgcggacatcacttgagaccaggagttccaaaccagccctggcaacattgtgagacccatctctataaaaacaaaaaacagtccactaaatcagccacattaattgggaatcatatgtcacaggtcatttgtggggcaaacatcactgcttttccatcaagggagcaaagaataagtgggagttttggaagagtttggatgagagacgccaaggtgcccagcgttcgtaaggcaacatgcagcctggcgtgaagcagtattttgaaactgcaaatggttcccttcttgtgtcctttcaatgctgaatattttagtgtcattctgcctgtgctcagagctccagcagcagaagtgtgtgtggttaattaggacacttctgtgagaggacccctgcacacattacgacaggtccctaaatgagcatttcccaaactaggttccccgaggcactctacggaaacaagatttttttttttgagacggagtctcggtctgtcacccaggctggagtgcagtggtgcaatcttggtgcaatcttggctcagtgcaatccgcctcccaggttcaagcgattctcccgcctcagtagctgggattacaggtgcccaccactgcgcccagctaaattttgtatttttagtagagatggggcttcaccatgttggccaggctggtctggaactcctgaccttcaggtgatccacctgcctctgcctcccaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcaaaaaaaaaaaa

SEQ ID NO: 100694 - DNA, 2943 bp, Homo sapiens
ggcccagccggggagggaggaaggaggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggttcttgctctgtcacccaggctggagtgcagtgccaactccgctcactgcagcctcaacttcccgggctcaggcgattctcccacctcggtctcctcggtacctgggaccacaagtgtgcgccactaggcctggctaatttttggtgtttttagtagagacagaattttgccgtgttgaccaggctggtcttgaactcctgagctcaggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccaccagaacctcaagtcccccaccagggctgcactgggcggtggggacggagccaggatggtgggggcagggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatccctcaaggctgggtgtggaggctcacacctgtaatctcagcattttgggaggccaagtgcggacatcacttgagaccaggagttccaaaccagccctggcaacattgtgagacccatctctataaaaacaaaaaacagtccactaaatcagccacattaattgggaatcatatgtcacaggtcatttgtggggcaaacatcactgcttttccatcaagggagcaaagaataagtgggagttttggaagagtttggatgagagacgccaaggtgcccagcgttcgtaaggcaacatgcagcctggcgtgaagcagtattttgaaactgcaaatggttcccttcttgtgtcctttcaatgctgaatattttagtgtcattctgcctgtgctcagagctccagcagcagaagtgtgtgtggttaattaggacacttctgtgagaggacccctgcacacattacgacaggtccctaaatgagcatttcccaaactaggttccccgaggcactctacggaaacaagatttttttttttgagacggagtctcggtctgtcacccaggctggagtgcagtggtgcaatcttggtgcaatcttggctcagtgcaatccgcctcccaggttcaagcgattctcccgcctcagtagctgggattacaggtgcccaccactgcgcccagctaaattttgtatttttagtagagatggggcttcaccatgttggccaggctggtctggaactcctgaccttcaggtgatccacctgcctctgcctcccaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcaaaaaaaaaaaa

SEQ ID NO: 100695 - DNA, 1959 bp, Homo sapiens
ggcccagccggggagggaggaaggaggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccaccagaacctcaagtcccccaccagggctgcactgggcggtggggacggagccaggatggtgggggcagggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatccaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcaaaaaaaaaaaa

SEQ ID NO: 100696 - DNA, 1690 bp, Homo sapiens
ggcccagccggggagggaggaaggaggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccaccagaacctcaagtcccccaccagggctgcactgggcggtggggacggagccaggatggtgggggcagggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatccctcaaggctgggtgtggaggctcacacctgtaatctcagcattttgggaggccaagtgcggacatcacttgagaccaggagttccaaaccagccctggcaacattgtgagacccatctctataaaaacaaaaaacagtccactaaatcagccacattaattgggaatcatatgtcacaggtcatttgtggggcaaacatcactgcttttccatcaagggagcaaagaataagtgggcacgagagagagaaattatgagattgagagagagagagagagagagagagaaagagaagagagagagaaagagaaagagacagagaaaagtattatgtgtgtaaagccc

SEQ ID NO: 100697 - DNA, 1848 bp, Homo sapiens
ggcccagccggggagggaggaaggaggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccaccagaacctcaagtcccccaccagggctgcactgggcggtggggacggagccaggatggtgggggcagggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaaaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcaaaaaaaaaaaa

SEQ ID NO: 100698 - DNA, 1486 bp, Homo sapiens
ggcccagccggggagggaggaaggaggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccaccagaacctcaagtcccccaccagggctgcactgggcggtggggacggagccaggatggtgggggcagggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatccctcaaggctgggtgtggaggctcacacctgtaatctcagcattttgggaggccaagtgcggacatcacttgagaccaggagttccaaaccagccctggcaacattgtgagacccatctctataaaaacaaaaaacagtcca

SEQ ID NO: 100699 - DNA, 940 bp, Homo sapiens
gtcttctaatagatctgaattacaacatttccaaatctgagtcaggtagtatactatgattgcatttgctttcctgtacaatgtttagttcctcctggagtcaataacggccttgattttatttgcctagcttgctcaatacttatagttaattctctccaggctttctgacagaaccataaaacctctctaaataaggtcaatatcttccattttttcttagatttccttaacatagctgctgctcccatctgttctggctgtctcacatgccaaagcaccgtttttctagtacttctttcactaacatcttagggattcattttgcttttatcttgtgttggcatcttatttcctggctcccctgtcaatattttcttagtttattcttttattttgttggaacacaacctccagtagtttctttggaaaaaatgagagatacaagttttgaaaatttagatgtctgaaaatgcttttattctactctcaatattgattgaaggtttggctgggtataaaattctatatttattctttaaagagccttctcactaaaatatagccagaccctagaaaaattgccttaaatacaatttctatttttgtaatcatactcacaaaacataaggaaaatgaaaataacaaacttaggaaactattctttcatcattgagatctataatttaggtcaagtattcccagcattggctttacactagaatcagctgtggaacttacttaaaaaaaaaaagaaaactgatactccaaaatctgatttaatttgtctgcaatagggatgggtatagtttgttggtttttaaggtttttcgtttgcttgtttgtttgtttgtttttagtgagagacttctcccagtcagatgtagaatactgaattttttatgtgtgttttaaaatatacataacctaaaatttatca

SEQ ID NO: 100700 - DNA, 219 bp, Homo sapiens
ggactttctaatctattctggaagtggacatcaattaaataattacacaagcacgcatattattacaacccattttataagtgataaaagcatgggatagacggggcactctaggctgaaggtcagagaagacttcgttgtagaagtagtaacatttgctcagagatctcaatgatgagtacacattaactgaggaaggagaatggggagcgaggcatg

SEQ ID NO: 100701 - DNA, 301 bp, Homo sapiens
aataggtgtatgaaaatatattcagtaaaaattaaaagaaaatggagaattttaacctactttaatattaacagacctcagaattattgatcagatgtagtctgattcacttgagggagcgttttggtaacattgtcaggagacagttttctgagggtccttcatttagctgcaggttttgtgagcaaagcgagcaaatcactgcctgtcctttgttccggaatatcttttagaggattctggtgtagcagacagctacagatgcagtgtcttcctctggagtcaaggacaggtttgctta

SEQ ID NO: 100702 - DNA, 1076 bp, Homo sapiens
cccgcccgcaaggcttttcgggagtcacggtctgagggcgacccgggcgacccggtcgcccgtgcccggctgccactgaccgctccaacgccgccagggacgacccgccagctgcctccggagccgagcaggccccgaaccttcccattcctagatttccagccgcacaacagccgcggtgcccctggctcgacgcagctggccggaggcgcggagctggtcgttcgtcccgcccgccgttccgcgcccctctcccggctcttgtttcctcgcctcttaacgaggcctttgtgaggaaggttgctgggccttgggactctgacgatcggctggaaaccaggcctggccctgtttcagcatccccgcgtgccaagccctgggccggcgtgcgggtccctgcccctgcgaggaagctgggacttttgcaggcctgggtggagacgtgtacataacagaggaagagtgtggaggattggaggactcagggcagcacggcagaggtgcatgcaggtccccggtcggactggagaatgggcggtgggtttcttgagctccagtccctgagctcgactttgacgtgggtttagcaaccaggaaaaaagcccaccttgtccctgctgcctgagaatacccagaccttagtccatggccagcatctctggtccctcggcaccctcaggcaacgtgaaggtcaccccaaatgccttgggttacattgtttccttacagtgagtttgtttgttttagtggcgcgatctcggctcactgcaagctctaacctcctgggttcacgtgattctcctgcctcagcctcccgaatagcgggtgtggtggcatgtccctgtggtcccagctactcaggaggctgaggcagcaggattacttgagcccaggaggtcatggctgcagtaagctgtgattgcacgtcagcttgattgacagaatgagaccctctctctctcaaaaaaaaaaaatcagatttagaaaaagtaatattagtaatttgtattttacagcctaaggaaaagttagggttttctgtttgtaactgtaatatattgaagatgtgatgttga

SEQ ID NO: 100703 - DNA, 729 bp, Homo sapiens
atatgaaaaaaaatacttacacacacgtttattgtctatgtgcctatttgtatatccgcaccatgctgttttggtgacaatagccttatagtcaatatagacaatagccttatagtttgaagtaaggtaatgtgatgcctccagatttgttctttttgcttagtcttgctttggctatgtgggctctaagagaatacaattttgttattttcaatcacatggctaaacctggcagacagtatattagctgaaattagccaggcacagaaggataaatatctcatgatttcacttagacatagattctaaataacttaatctcattgaagtagagagtaacatggtgacaaccagatgctaagatatttagaaaaaaggggttggaaagttatctgttaaagaatacataattatagtttgttaggaggaatgagtttaagagatttattttgcaggctggtgactttaattcataataacgtatttttgaaaaatgtgaagacaagattctctcactagaaaaatgttaactatgtgaggtaaagcaattaagaattaatcatttgacaatgtatacatacttcaaaacatgtttggccaggcatggtggctcatctctgtaatcccagcactttgggaggccaaggcaggtggatcacaaggtctagagaccaaggccagcctggccaacatggtgaaaccccatctctattaaaatgacaaaaatta

SEQ ID NO: 100704 - DNA, 166 bp, Homo sapiens
aggctcatctgaggaaagcaagggtggcactctctcaaaggtaggtgaacatgctgactgttctgaaatatttatataatggtcatataaagaatgctatgctttctcagtgtagatgttaaaaacaaaactaaatgcagaagtagaaattacatgaatacagaat

SEQ ID NO: 100705 - DNA, 107 bp, Homo sapiens
gaggttggtcctctgcacttctggtctccacttgacacccaggaggaggtaccatcacaccccaggacctgctgtgctggcgttgtgtttctgccggagtcacctct

SEQ ID NO: 100706 - DNA, 517 bp, Homo sapiens
cggacgcgtgggtcgactgtgatgctagcactttgggaggctaaagcaggtggactgcttgaactcctgttcaagaccagtctgggtaacatggtgaaccttgtctctgcagaaaatacaaaaattagccagatgcggttctgcacacctgtggtctcaactgcttgggaggctgggatgaggcaagagaattgcttaagcccaggagtttgagaccaggctagacagcatagtgagaccccatctcttaaaaaaaaaaatgcttggcctcccaaagtgctggaattactctgtctcaaatcaaacaaacaaaccgatagaattagggagctctatgagtgtagagttgccctactagtcctgcatggcttctaatggactctatttatgtgaaagagacaaatttccagtttaagccactgtaatttacatttgttgttgttgttgagatggagtttcgcactccagcctgggagacagagcgagactccgtctcaaaagacaaaaagaaaaaaaa

SEQ ID NO: 100707 - DNA, 526 bp, Homo sapiens
cacaaaaggcccctggacctaagtgagaactagaggcttctgctcccagggaaggagctgatttgacttctgctaccccttgctgggctcagcattgctccccgatgcaggcctgtcagcaagggaaggggaagacactgctgcaccctgcagccctctctctgctgtgtctgttccttcctacacggggctgctcccaggctctggttctcctggcccctgaaaatgttaccttaggccagggattctcttaggctggagagaacaatatggagattctccttcagggaggggaggctgctgggctcgcccagtctgagagttagagtgctgggcttgtcccaggaagggaaatgaaggcttggtgggggagggaagacagcccttagtgctgacttgtccacctgatgggaggtgggatgagggggtctgggtctaggcccttcggggctgggctaggctaggggatctcgctgcccatgactatgggttggggccctgtggtgagatgcttcctgcttcccta

SEQ ID NO: 100708 - DNA, 331 bp, Homo sapiens
cacatccaggtcaagacaaaaagcagcacacccactttccatcccccatgcggacgggctgctgtctagtccatcctttctcccagcatgcaaacttttaccaggtcctgttttaggcagggctcttgattcctggtatcatctctagtctcggaggagatgcagtcacgactcaaacccttgggctttgaggccaggaagcacccctcaacacctctcccaacccccaggcctagacgagcctcagctggagctcaccgtccacactgcctgagatccctggggatttcccttacattccatgagcttagctcttctttgaaaggacgct

SEQ ID NO: 100709 - DNA, 425 bp, Homo sapiens
tagtagagacggggtttcaccgtgttagccaggatggtctcgatctcctgacctcgtgatccgcccgtctcggcctcccaaagtgctggtaggttgattattaataatgctgctataaacatctatgcgcaggtttttctgaggacatgttttcaacttaattgggtaaatacatagccgcgaggttgctgattgcgtagtgaaaccatcgtgctatttatgaaattgcaaacattcgtgcaaagtgtctaaaccttttgcattcccactagcaatgaacaagagttcctgctgctcctcctcctagtcagcatttgatgttagtattctaatgttttgccattctaataggattgtagtggtatctcatggttgttttagtttaaattccctagtgacgtatgacgctgagcatattttcatat

SEQ ID NO: 100710 - DNA, 422 bp, Homo sapiens
ggaatgtgagattgggacggtaggggggcgaggcagagcctagttggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100711 - DNA, 537 bp, Homo sapiens
cgagttcaagcaattctcctgcctcagcctcccaagtagctgggattacagattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100712 - DNA, 439 bp, Homo sapiens
ataatttattatcttcttgctttctcatcattaatgttatgtatattattttctttcagtttggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100713 - DNA, 439 bp, Homo sapiens
atatttaaattatattgaagtattattaataaacacccacacacaccccgagatcacgagttggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100714 - DNA, 431 bp, Homo sapiens
tataagagtaattcaaggataataatagagacgcacgcgacaagcaagttgattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100715 - DNA, 433 bp, Homo sapiens
  misc_feature (1)..(1): n is a, c, g, or t
ngaagtgatgtagatggagaaagatggtagtcagtgcacgaaggacaagacttattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100716 - DNA, 675 bp, Homo sapiens
gcaaacacttagtctttgatttaagtcaccaccactatgactcctgtcactctgattcacccacagttgggtaaataattattgcttttattaatcttaaatgtatttatagttcaaatttatttcaatggttaatattagaagtgtttgagctctttatttagaagcttggtgatatttttgtgactagaaatatgcctgagaaacttaactcttattaattagcctacggtacaattggtttctttataagttgttttgcttaaagttgcagtttccaagaacctagtgacaatattaagtgaggacctactttatttgctcatgaggtggtattgcgatataaaaatcaaagttgattctcgtttttgtttccaggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100717 - DNA, 346 bp, Homo sapiens
tttttcttactttttttttctagttttagattttgttatttatattttggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100718 - DNA, 350 bp, Homo sapiens
  misc_feature (43)..(43): n is a, c, g, or t
tttataatcccccacaccctcacgcatcatataaacaaacacnaccacttttagtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100719 - DNA, 344 bp, Homo sapiens
  misc_feature (21)..(23): n is a, c, g, or t
  misc_feature (25)..(26): n is a, c, g, or t
gtttgatgttcaatttttggnnngnntttgaacaaattttcaacttcgtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100720 - DNA, 487 bp, Homo sapiens
ggaatgtgagattgggacggtaggggggcgaggcagagcctagttggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaaaaaaaaaaataaaacataaacgtaatagttacgtattatttagtttttgggcctcgttggcctca

SEQ ID NO: 100721 - DNA, 821 bp, Homo sapiens
  misc_feature (32)..(32): n is a, c, g, or t
  misc_feature (34)..(34): n is a, c, g, or t
  misc_feature (46)..(47): n is a, c, g, or t
tttttttcttattttggtccacacaaataaananaaaaaaaaaaanntagtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaaaaaaaaaaaaaaataaattactaacactataataaatgtaaccagtatgtttagtttgttaaatgtagtgggcatgtacgatttcttgtgaagattaaataattcgctttgtgttgtccatttatttgttgtatttgggtggctatttctttttttaggggcgggaatttataactctttatatatgaaagttgtacgccaggagttttttagtttgatagtttgagtatattctatatgtttgtactttgtgtacttcatttttattgggaatcttaatataacactctttatgcaatatatatctagtttgtatattattggaaaatggacatagtattatttattgtacaactcgtttcatatttttaagtgtgaggattattttgatctttgtgggaggaggtattcgcgcgttcttaatctaatagtgttggcatcctggacactcttcctattgttgagatgtatatat

SEQ ID NO: 100722 - DNA, 1045 bp, Homo sapiens
taactccttccctctttgcggattctagaacggaacctttttttaattcttcccagtagaaacgtaggaacaatttcgtgaacgcaatccggagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100723 - DNA, 368 bp, Homo sapiens
tttctttttctatttatctccctaatctgttattatcaataaccactaggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaaaaaaaatgatatataacaaaaa

SEQ ID NO: 100724 - DNA, 380 bp, Homo sapiens
aattatttaatttagtatcttttataatttacggtataaaaaaaaaataaattgagtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaaaaaaaaaaaattggactcattggtctca

SEQ ID NO: 100725 - DNA, 376 bp, Homo sapiens
  misc_feature (32)..(32): n is a, c, g, or t
tttcaattttcctcattatttattactctaanaatcctccacacaggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaaaaaaaaaaaatcggccttgctggcctcaacgcc

SEQ ID NO: 100726 - DNA, 456 bp, Homo sapiens
  misc_feature (11)..(11): n is a, c, g, or t
  misc_feature (13)..(13): n is a, c, g, or t
  misc_feature (33)..(33): n is a, c, g, or t
  misc_feature (40)..(40): n is a, c, g, or t
  misc_feature (65)..(65): n is a, c, g, or t
ttgtactgggncnctttttaacaatagaaagtnaaaaaanaaaaatgtaaataggaatgctgggnggcaacgttaagttggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100727 - DNA, 430 bp, Homo sapiens
ataacatctatatatttattaacccattcgaataagcttcccacaaattatttggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100728 - DNA, 426 bp, Homo sapiens
acccacaaatacaacaatctattttctttattaattaaaataatcagttggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100729 - DNA, 1323 bp, Homo sapiens
taactccttccctctttgcggattctagaacggaacctttttttaattcttcccagtagaaacgtaggaacaatttcgtgaacgcaatccggagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaaaaaaaaaaataaaacataaacgtaatagttacgtattatttagtttttgggcctcgttggcctca

SEQ ID NO: 100730 - DNA, 1280 bp, Homo sapiens
taactccttccctctttgcggattctagaacggaacctttttttaattcttcccagtagaaacgtaggaacaatttcgtgaacgcaatccggagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaaaaaaaatgatatataacaaaaa

SEQ ID NO: 100731 - DNA, 355 bp, Homo sapiens
ttactccccctctcccctgttcctcccactctttaccttacaaactatataattactagtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100732 - DNA, 345 bp, Homo sapiens
tccctcccaaccctctatttttcctttatgagacacagacccttttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100733 - DNA, 346 bp, Homo sapiens
ttttttttatacttcctctcgtttctatttacatatagttatcacttcagtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100734 - DNA, 339 bp, Homo sapiens
tttttatttctgccttactttttatcgcattaaattattctagtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100735 - DNA, 346 bp, Homo sapiens
tttcatccccccccacctcgctcccgtgatcccaccccctcaccagttagtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100736 - DNA, 1288 bp, Homo sapiens
taactccttccctctttgcggattctagaacggaacctttttttaattcttcccagtagaaacgtaggaacaatttcgtgaacgcaatccggagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaaaaaaaaaaagggaaaatgataaacaggaaa

SEQ ID NO: 100737 - DNA, 1258 bp, Homo sapiens
taactccttccctctttgcggattctagaacggaacctttttttaattcttcccagtagaaacgtaggaacaatttcgtgaacgcaatccggagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaagaaaaacgtggagccatttaccagtgttcttagtttgccatacccatttgcttccgaaatcaataaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtccctttgtggtacgtgctttccttcgtagttcaacaagtgaaggtttattactgaagattgatccattgttgcctaaagaagtaaaaaatgaagaaagtgaaaaagaagatgcctaaatgtggtgaattgtgaaattactttcagtggtttaagaagcaatggagaaaatgataatacagcataatttttacatttgatgtcttgttattgatcatacttgaaagtgaactttaacattgaaaaatcgtacagtcatttcaagaataagaaaataaaattttctctttgtctgaa

SEQ ID NO: 100738 - DNA, 360 bp, Homo sapiens
tttttttttgagacagtcttgctttgttgcccaggctggagtgcagtggcatgatctcgcctcactgcagcctctgcctcccagtttcaagcaatcctcctgtctcagcctcgacatcccaaagtgctcaggttacaggtgtgagccacccccacctggccctgaaaccattaattgtaattgttgattcccttaggttggctctgtagatgctgtcacctataaatgtttggctgcttcctttccaatagttctaattctttttgttgccttactacatgagctggaatctcaaatatatactgaaatagatgcagagacacaggaactcttagtttcttgctgactttaatgggaatg

SEQ ID NO: 100739 - DNA, 244 bp, Homo sapiens
aagatcgtaccactgctctctagcctgagggacaagagcgaaactccatctcaagaaaaaaaaaaattgtaaatcccaccatgtccactgagtccacattgttctgggactgttttttagtttcttactccctgaatacactctggcagtaaagtgtttatacagattacgttctttggatactatagaattaaacacacaaacacacaacgaaatatttaaggtgtgtggagccattgccatt

SEQ ID NO: 100740 - DNA, 361 bp, Homo sapiens
gtcactgccagtcaaagggggtcaggagaacaaggcagcagaagaaaagtacctgagaagacaggagcaggtaccccttggaattcaccagggacccttgctcccatccttgaagaggcctctggccagccatttctccatatggttactaatgtaaagtgagggtgctcctctcaaaaaaatgattagtgccctgtaaataaatctctccgtggatgttaatgcacagaggacctggccccgtgggcctggctgaactgccattttcccagccctccttctcttgcctcaggctcatttttccactaggccccttctctctcagctttccggcacttagtaaccattagagtttgcattc

SEQ ID NO: 100741 - DNA, 410 bp, Homo sapiens
tcttgctctgtcacccaggctggagtgcagtggcacaattacagctcactacagcctcaatttcccaggcttaagtgatattcctgactcagcctccctagtagctgggtctacaggctcatgcaatcacaccagctagtttttttaagaggtggggtctcactatgttgcccaggccggtctcctgggctctagcaatcctccttccttggcctcccaaagtgctgggattacaggcatgatctaccatgtcctgcaccttctatttgcagggcttgtgctatggcaccctgcagggtgtgcagccagagagaggggaatcacatgtgtctgtcttccagtaacttcatgactccaataactaacacagcctagaaagactggaattaccctgagagcagaaagggtca

SEQ ID NO: 100742 - DNA, 449 bp, Homo sapiens
ccagtctatctctgtgcgcatttaggttggtttcatatctttgctgttgtgaatagtgctgcagtgaacatacatgtgcatgtgtctttataaaaagcggtcaaaggatatgaacagacacttctcaaaaaaagaaatatgtgcagccaacaatcatgtgaaaaatagctcagcatcactggtcattacagaaatggaaatagaaaccacaatgtggtaccatcccacatcagtcagaatggctactattaaaaaagtcaaaaaacaccttactgagtccttactagattaatgggacgcaaacccacaaaaatttagttaacagctaaatatcctaatcaactagcttcaatctactgacgaggttgtggagaaaaaggaacacttttacactgttgttgggagtgtaaattagttcaactgctttggaagacagtgattccacaaag

SEQ ID NO: 100743 - DNA, 689 bp, Homo sapiens
ttttagtcttttatctatgcattttcaagatggaatgtttccagagaagctgtgtgtgacatagtttgtgaaatgttatactgtagtttgaaaaatattattttgatatagctagacacaggaccagtatttcctagaaatgcacactgggccgggcgcggtggctcacgcctgtaatcccagcactttgggaggccaaggcaggtgaatcacctgaggtcaggagttcgagaccagcctggccaacatagtgaaaccccgtctctgctaaaaatacaaaaattgggggaagggatagcattaggagagacacctaatgttaaatgacaagttactgggtgcagcacaccaacatggcacatgtatacctatgtaacaaacctgcatgttgtgcacatgtaccctaaaacttaaagtataattaaaaaaaaaatacgaaaattagctgggcatggtggtgtgtgcctgtaatcccagctactcgggaggctgaggcaggagaacccgggaggtggaggttgcagtgagccgccattacacctctgcactccagcctgggcaacagagtgagactccatcttaaaaaaaaagaaaaagaaaaagcacacaggagcctgtatgtttattggcaggtcagtattattcacattcaataatcattcaaatccagttatttggaatattgttcc

SEQ ID NO: 100744 - DNA, 857 bp, Homo sapiens
taggcacatttaggtatttttattttgttgaaatttacaacgaagatgtcatggcttccggcagattcccacgtttgccagcagcagatatatcatcctgagaacttggatcatctctgatgttgagcaatttgccaacattcatgaccagttaagtagatttaaatgcgtaattgcctcatgcttaggaatgcgtatttcagtttaaagataacgtcttaacttcccaagagtaatctataaaagcatacatctcatatttcagattttggaaaacattctttttccttttgttttgcctgtgttcaggagaacactagtctgttgcaggactttttttctacttttataagccacagaaatgcatattaaaaacaaaacaaacagaaaaagcaggatttcacctagaggtttaaaataaagttaccatattacagacttggaaaatggtaatgaagagaaatttatattggtttctagccaaaattctatgtttaggaagatggggaagtgccaaaattagtaatagctgattcaatattgtaaaattctaattgaaaataaataccaaattttatacttcagaaaatccttagagtttttctactcaaacctgctctatttatgttggaaaaattaaagagatccgaagaggttacatcacttgcctaagagtcacatggttaattactgatacaattaacattaaagtctagatttcaaggatagtaaggatgatggtgatggcactataaataaattagagggtccactattactgtacactcatcattgttcaagactttatattttcttttcatagatactttgaaaatttgatcttattctcctgtatt

SEQ ID NO: 100745 - DNA, 374 bp, Homo sapiens
cagaaaaatggcagtgaggtatcctgggaaataagtgcatttttctaatttgtacaaattgtcttttgggcaagtagtaaatcagtgcaaatttgtggccttcagataaaaaaatacagatttggcttacatttttttctccttcttttttttcttatagctagagaatcagtaccaacatttttttaaatgtgaatttttgggccacattttaaaattggaatatttaagatttaaaaaatccagatttacagcctctttttctttcttttttggagatagagtcttgctttgttgcccaggctggagcgcagtggcacgatcatagctcactgcagcctcaaattcccggcctcaagcgatcctcccacctc

SEQ ID NO: 100746 - DNA, 603 bp, Homo sapiens
aagaagaagatagttcccagatgactcaggaaaattttcctcgtattctgttgccagaacatggacacatacccattcctgaaccaataactgccgaggggcaggtccttcaggagctattctaggaaaagacattgttatcaccagagatgacacctccctgcatgctgttgcccctaaagatcttccaatgggacaagatgtggaggtgaaagacagtgacattgataattctgaccctgttgtaggcctaggctaatgtgtctgtgtgtctgagtttttaacaaaaaagctttaaaaatgaaaataaaataaaaatagaaaaagcttgtaaattaagatattagtcagttttcacaatcctataaagaacttccctgagactgggtaatgtataaaggaaagaggtttaattgactcacagttctgcatggctgggtaggcgtcaggaaacttataatcatgccagaagagaaagcaggcaccttcttcacaagacagcaggagagagaagaacgaagcaaaggggggaaaacccccttataaagccatcagatctcatgagaactcactatcacaagaacagcatgggggaaaccgccc

SEQ ID NO: 100747 - DNA, 322 bp, Homo sapiens
aaaaaaaaaagtcagttgggaaactgggtcattaaagccacacaaatttgtttactgcaggacttttcggagcctttgacatgctaatacatacagtgactttccaagtgggaccaaggtatgtggtatttcccaaactcatggaatgcctcacctagctggtgttcacagaacaccttttgggcaatgctaatctgcctcccctcccctcactgtacaagtgacggaatgaaggcacagagcgggagagtgagttacccaaggtcacacagctgctgaattgcagagaaagtcctggcacctgaggcctcctagtgttctt

SEQ ID NO: 100748 - DNA, 809 bp, Homo sapiens
aacgcggtgtctgggcgttgaaaaagggcagtaacagcagtgcggaaatcccggcggcgatagagataaccacaaaaaatccgctccagtgccaggtatcgagtactttcgccagcggccaaccagcaagcgacgcccccagataagcaaacaagccgacaaaccccgtcgccgcccctgccgcctctttgtgggaacactctgccgccgccataccgattaacatctgtgggccaaagacaaaaaaaccaatggtgaagaagcaggttgcctgcatcacgtagctggcaaatggcataagccacagggagccgactgaaagcaaaattccggcggcgaaaatcaaattcatcggccctcggttgccgttaaacaatttgtccgagccccaaccggctaccagcgcaccgataaatccgcccagttgaaacatcgtcactgccgtattcgccgtgaccagatcgtatgagtttactaaggaaatataatagaagttttgggtctctgaaaccttgaacgagttgcatttaaatttaacaaaacgacactaattttcttatttattttttcttaaatgaaatttaaactccaatgcttttaagccattttagatacatgagtcactggatagctgctaaatattaacctgggagtgatggttgattcttttgaaaaagaaatagtcagtgtcaatgtttctgtaacagagaccaataaactggagaaaggctgataattatctacaaattgtagtccatgataaaattcttactgtttaatatttttaggtttgacatagaaaatatata

SEQ ID NO: 100749 - DNA, 388 bp, Homo sapiens
cgtgtgtgcgtgtgtgtgtgtgtgtgcacatgcacattagggaagacggggcacctgggatacactctccaggtctctgtttctgtgctcatctccctaccttctctcaaagttgcaattggttcaggtgaccccaaggcctgaggctgctgcggtggggggcagagcagtcaggtgaaaagtgctcagtcccacagagacaccccatcgggttccatttaatgcaggctctgtggctcccaccaccctggggccccatgagccctgtggcgtgtgtggtcatggcctgtgcaggccctcatgtgcgctgtgtctctgcacacccagttaatgtcacaggtggtgcactcacacaggacgtgcacatgagctgcacagctcgcatgca

SEQ ID NO: 100750 - DNA, 458 bp, Homo sapiens
aagatgagaatttgtttttatttctgtaacagcttcattgggacaaaatccacatgtcatacaattcacacatttaaagtgtacaattcaatgtttttagtatattcacaaagttgtgcaaccatcactacaattaatgttaaaacattttcatcacctcgaaaagaaaacccataccttttccctatccagccttaagcaaccactaattcactttctgtctctatagatttctctattctggacatttcatgtaaataggatgatatgatatacaacattttggcttctgccacttaacaatgtttttaagtttcaccaagttgtatcagtacttcatttctttttatggctgaataatattccattatataaatataccacaaagtgtttattcatttgttcgctgatgggcatttgagtcgtttctaccttttgactattatgaataatgttgc

SEQ ID NO: 100751 - DNA, 258 bp, Homo sapiens
gaagaattatttagtaaattgttctagtatagttaataatgtagcaaacagtagatcaaattggatcatcaacattataccatagcaaaagaaatttgaaatagatgaaaacatcacattttaaggaaaactatcttatgtctatatttgaaacaactttcaagttgcaaatataatagaaaaccataaggaaacaatatatttgaatacataaaatgaaactttctgtcataaagtaaaaaaatgaggaagaaatgt

SEQ ID NO: 100752 - DNA, 166 bp, Homo sapiens
ggaaggtggggcctaatatgaggtaattaaatcatgagggttctgccatcaggaatggattaatatgattatcaaaggaatgggttaattatctcaaaaatgagtttgttataaaaaggagtttggtcccctcctgctctcttgctctcaccatctcttgcccttc

SEQ ID NO: 100753 - DNA, 653 bp, Homo sapiens
cacaggacatgctccgtcagcacaagcactcccaagtcaatctgaaaagcaggcagcagcattgcaggggacaggtcctcccctgatctgggtggtggtcttctcccacttaaagcactatatacagggggaggtcccaggctggacatctttaccaggggctgggagaaagcaggccgtgctctgtggtctcagagtcttcctggcgctctttggaacctgacagaacatgacctcagtcccagccagcgagtggcagagaggactttgtacttggctgcaataaaacatgcccttcttcgcagagacacgaacaatctcgtctctaccagaggcctgtgagacatcagctcaggaccttgacctgcagacacctcccctgtgcacattcttgatctcagactttcacaggtgctttctgtggcaggaagagtgagggtcccaggaaaggtgtggatcccagaagtctcactcagtgtcaccctcacggacacactgggaaactggtccgaccgagtccaggaagacagcagacacacgtgtcctctgtggcaccagctcctgtggacacgcccccagcaccgcaggccatgccagttactacccgggccaggctcggggacacagcctcatggtcctgagtagacgcaaag

SEQ ID NO: 100754 - DNA, 264 bp, Homo sapiens
gcaaaaagttgcacatgatgtttatgtgcagctttgttcatgattaccgaaacttggaagcaaccaacacatcctccagtaagtgaatggataaaaaattatgggacatcaatacaatagagtttctttgtttttttattttctacaacagggcctcactctgtcacccagggtggagtgtagtggtgcgatcataactccctgcatacttgaactcctggactcaagcaatcctcctgcctcagcctgctgaatggctgggac

SEQ ID NO: 100755 - DNA, 409 bp, Homo sapiens
aactaaatttcctctttttcacaggctagataattgtttttctaaattcactaactccatagaggtgcttcctgccacgggccacttgtgataaatcttgagatatccctgcaatcaaatggagtcagagtagcacattctgatgctgctttaggtggaagaaagagttctttctttacaggaaaaaggatccagaagaaatcagcctgccagaaagatgtgatttttttttttccctagacttccctggatatattataatgatgagaactaatgtctgaatcctttaaatgccaataaaatatacatttggggtaatgcagttattatgaaaatataaaagccagtgttacaggcatttctattttacacctgaaaaaggagagttgcctagatacttgcacactgg

SEQ ID NO: 100756 - DNA, 825 bp, Homo sapiens
agcttgtctttgtttcacgttgctgtaatggaatacctgagattgggtaatttataaagaaaagaggtttatttggcttatgattctggtggctagcaagtccaagattgggcacctatatctggtgagggcctcatgctgcttgcactcatggtggaaagcaggacagtgagtgagtgcaaagagatcacatggtgagaaagaaagcaagaaagaaaaccaaggaagcctttttaacaacctacactggagggaaccaatcctttggttccaatcctcttggaaccttctttggaaccaatcctcttgttttctgtgaaagcaagaacttattcacccactctggaaggcattaatctattcaagagggatctgcttcatgacccaaacacctcccatgaggccctacctcccaacactaccacattggtccacatgggaagcttattcaaaacaagcagagaaaaatgactataagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggacgaagatggaaaccatcattctcagcaaactatcccaaggacaaaaaaccaaacaccgcatattctcactcataggtgggaactgaacaatgagaacatatggacacaggaagcagaacatcagacaccggggcctgttgtgaggtggggggagggaggagggatagcatttggag

SEQ ID NO: 100757 - DNA, 258 bp, Homo sapiens
tgtggcttcgtggtcactgctccagcctcagccagggcagggagggggactccgagacagggaagaccggggccctcctcccttatggggccggcacaatcagtgggctgggcggagccgcagctgcaaactctgacacaaaagacgtgccttaaggaacccgccgcgtgcccaggtgccccgcggggcatccagctcggccccttggccgcccccctcccaggccccagcgtcttctccccagccccgtcctcccac

SEQ ID NO: 100758 - DNA, 667 bp, Homo sapiens
agacagtctccttgtgcgatctcccagacatgagagccctgctgggctttctggctcctcctccgtgcagagttgtcccgtcaggagccaggaggggcgacgctggctccgtgggagggtgaacagtggctcaagatgagaagcgtattgagacaaagaattctgaaaccgaaagatgtggccatttattctggagaagtcaaccaagttattgctgacttaattaaaagaatctacctcctcaggagccaggcagaagatggagaaaccgtgaccaatgtcaatgatcttttcttcaaatattcaatggaaggagtggccaccatcctttatgagagtcgtttgggctgcctggaaaacagcatcccacagctgactgtggaatacatcgaggccctggagctcatgtttagcatgttcaagacctccatgtatgcaggcgccatccccagatggcttcgccccttcatcccaaagccctggcgggaattctgcaggtcctgggatggactcttcaaattcagccaaattcatgttgacaacaagttgagggacatacagtaccaaatggaccgaggccggaggggtgagcgggggacttctcacatacctcttccttagccaggctctgacgctgcaggagatctacgccaacgtgactgagatg

SEQ ID NO: 100759 - DNA, 735 bp, Homo sapiens
tccagggctgcagttattaacttctctctccccagcaaaaagtctttcctgtcttaattctactttgttgggcagctcttgttgattctttatggctgaaattttttctagaggttccttgaattctttcccagaatgtcagtgtaagtaagatgatttgaaactcacttgattcttctagggagggtgaacagtggctcaagatgagaagcgtattgagacaaagaattctgaaaccgaaagatgtggccatttattctggagaagtcaaccaagttattgctgacttaattaaaagaatctacctcctcaggagccaggcagaagatggagaaaccgtgaccaatgtcaatgatcttttcttcaaatattcaatggaaggagtggccaccatcctttatgagagtcgtttgggctgcctggaaaacagcatcccacagctgactgtggaatacatcgaggccctggagctcatgtttagcatgttcaagacctccatgtatgcaggcgccatccccagatggcttcgccccttcatcccaaagccctggcgggaattctgcaggtcctgggatggactcttcaaattcagccaaattcatgttgacaacaagttgagggacatacagtaccaaatggaccgaggccggaggggtgagcgggggacttctcacatacctcttccttagccaggctctgacgctgcaggagatctacgccaacgtgactgagatg

SEQ ID NO: 100760 - DNA, 185 bp, Homo sapiens
accctgccatcatcgtgtgaaagcagccagagacaatatgaacaagaataggtgtggctgtgttacaaaaacatttgttgggctgaatttggcttgagtgccattctctaaggagtcaacataatccagggaaaattatatggacttcataattagttttgataatcagaataacagaaataatt

SEQ ID NO: 100761 - DNA, 173 bp, Homo sapiens
gacaaattttgcatttgacaccaagactcaattgggcaaaaaaaactgatcttaactgatgtgagattatttatgttctatgtgtgaaatttactgaaaatttatatgtattcctgcagaaatatttgatgtggtaactgtgctcttccagatgctacacaacaaaaaaagca

SEQ ID NO: 100762 - DNA, 769 bp, Homo sapiens
gcagtaagatgctgtctatgaaccgggaagcagaccctcaccagatgctgaacgtgctggcaccgtggacttctcagcctccagaaatgcagatgacaagacccaaggagatggaggagccacacaactgaaagagatgaggttcctgaatcaccacatggagggaagtggccactgattagaaacatctgcctgtttcataaggataagtaaagagggaatggatgccacatggtgcagctgcctaaaagctaagaaggggtcatggggtaacaggaaataccaaggaaaaataataattgatccagagaaaaggaaagaagaatggacttgaaaccctcctgaggctctaatgatggtgattctgcaaggctgagagcagagatttacatatttgctgtcaaggtgaaggtaccacaacgtggatgccatctggcaggcacctgggtggctgacacgcaacatcaagtgcagtatcatgaaaattagccaagctgggccctggtacttcattgctacctggtgtgacggtggacacccaacatccacaccctggctcccagtctccccacctttaaaatggatttgatctccagattgctacgtttgtgtccatatgtaatggacaaaagtggtgatggactaacaaattacgggatgaggatctgcaggctttatttactactaaaatgtttatttcatgtgttgattatctgcagcatcgccaccttgcagttagtcactggagtcctctcagaataggaaccca

SEQ ID NO: 100763 - DNA, 711 bp, Homo sapiens
ccaagcagttgggacctcaggtttgccccactgtgcctgagtaatatttgtatttttttgtagagacggggtctcagtatgttttgttctgtgttgagacagggtctcactctgttgcccaggctggagtgcggtggtgcaatctcagctcattgcaacctctgcctcccaggtttaagcaattcttgtgcctcagcctgctgagtagctgggactacaggcacatgcctctatgcctggctgatttttgtatttttagtagagacagggtttcaccatgttggcctggctggtcttgaactcctggcctcaaatgatctgccctcctcagcctcccaaagtgctgggattatagatatgagccacgtgcctggccatcttgtttatgttttagagacagagtgttgctctattgcccaggctggagagcagtggctcgatctaagctcgctgcaacttctgtctcccaggctcaagtgatcctcccacctcagcctcctgagcagccaacatccattctactatggttccgtggggctctctctcttgcgatctgttctgtcactttcttgttggcctccaacctccctcatcctcactcagctgatgaccttgctttcggcttcagtgaaaaaatcaagcagaccttccgcacaccccaccaacagctgtgcccgcctgcctgtccctgtgccgtgcatgctgcctccc

SEQ ID NO: 100764 - DNA, 1229 bp, Homo sapiens
ggctggtttcttttgttgccttctacattcagtcttttggggtatgttattttagtcgaagtgtatggagaaaatacagctgcaatgataggtagtcagaaacagaggagcgtttttcagataattgtggatgttttttgacactacaccaaagctcaacaagtggaagattcatgtcagctgcaaggtggaatctgaaaccctatcaatgagcatttcattcattgttacattaaaatccattagcccatcttgcactttgaaaggctcttttacccatgcatggttttataacatgatgccatggccacttagaaaatgttggtttactgagttatgcacatcttttaaatatggatacgtttcattacacaatatcaaaatatcacatttcattaaattacaactgatcttgtcagaaatgtctctgaaaattctaagtattgaagagttgtcaagctcatacttgtggatgtaagtctttcaaaatccaattttcatttgaaagtttgactcataattatcattggtatcaaatactgtcagtttttctttaagtgatagattccctttgttcatttgacaaaatctgccaaaaagcgaagtctgaataaccagtttgacaattgttctttcaagtaaaaatggtgttccttgaagagtggttggtttagcttttaactctaaacttttcctggagatagccatcacatcttggtatgcagcaggactttatgtacgcatgcttcatattttaccccacaaagtattaaaaagagtcagggttgaatttcaataaaatgaatttatgctgctttgtgaagcacagtcttaatttaaattgtccctttttgaacttgtggtgaagaatacaatgattactggtgcagtttggtgccactgtcttgattcacgctaatgcaccagtagttttacccactgtggctatgaaccatgagtgcaaatgtcagcacagtgaaaaaggcaaatagcatcttagtatttattatgagaatagttttcaacttctgaatctccagaaaggattctggggactaccagggcctagggatttcacacttggagaacttctgccaatcatctactaaatattcaggacatgggccaggtgtggtggctcacacctgtaatcccagcactttgggaggctgaggcaggtggatcagttgagctcaggagttgagaccagcctgggcagcatggcaaag

SEQ ID NO: 100765 - DNA, 390 bp, Homo sapiens
ccatcctctcacgcgtccttccaggtccatccctggattattaatcaattaataattaattgacaatgaattattcatttgattaatatgaataattcccctgtgaactgcagcggcaaaagctctggccttgaatctaggcgcggcatttaccatccgtgtgacattaccaagccactgaggtttattttctcgtctacagaagaagaacgattaccatgcctgtctctcagggctgctgccagggttaactgagacaacagacagaaacctctaatgtcccctctccaggcctgttcaacccttcggctcttgcctcaagccggccgcgctgctggagtgtggactgaggaccagaccatgtagcccttgatcccctcacggcgtccc

SEQ ID NO: 100766 - DNA, 630 bp, Homo sapiens
ctgatggttaatcgtagacatctacttgactggattgagagacacacatagctggtcaaacacgatttcagccatgaatcaggcataaatattctgatggttaatcgtagacatctacttgactggattgagagacacacatagctggtcaaacacgatttcagccatgaatcaggcataaatattctgatggttaatcgtagacgtctacttgactggattgagagacacacacagctggtcaaacacgatttctgggcatatctatgagggtgtttctggaagacactgagataaccatgacccaatgtggatgggcactgatatggtttggctgtgtccccacccagatctcatcttgaattgtagttcctgtaatacctacatgtcgtgggagggacccaatgggaggtgactgaatcatggtggtggttaccgccatgctgttctcatgacagtgagtgagttctcatgatctgatggttttataaggggcttttcccctttgggtcagcacttcttgttgctgccatgtgaagagggacagctttgcttccccttctgccatgattgtgaggcccctgcagccatgtggaactgtcagcccattaaacccctttgttctttata

SEQ ID NO: 100767 - DNA, 343 bp, Homo sapiens
actcttttattcccaacaagttcagttttgctgacacttactgagagaggttatcatttggctgaacaccattgaccctctgaaagttatttatacatacatattcagggaatatatgtcacctaaattgaaacaattcaaattcttagtattctaatgacatgagctaaacctactggatggctccaactcatcaaaaaggacatggatgtttttcccttattaaaaataaaagagaccaggcgcagtggctcatgcctgtaatcctaacactttgggaggcagaggagggcagaccacctgagttcaggagttagagacgagcctggccagcatggtgaaa

SEQ ID NO: 100768 - DNA, 786 bp, Homo sapiens
gatctctgctcactgcaacctctgtctcccggattcgagtgattctcctgcctcagcctcccgagtagctgggattacaggcatgcacaaccacaccctgctaattttgtatttttagtagagatggggtttctccatgttggtcaggctggtctcgaacttctgacctcaggtgatctgcccaccttggcctccaaagtgctggaattacaggtgtgagccaccgtgcccggccaggagcttggtttttaatgggcttgccgtggccaagccaggccaggtgggagaagcggcagccttgccctggagggttttgagaagcactgctcctggaggccctggggaaggtccctgaaacctttggccaatgtggctgtccccatggtccacatgccctccccaccccctgcctagctgcttgactgcctgctgctccccagcccaccagcctgtccgtgggtcagcccagccacccgcttcggatctctgcacgtgtgtcacctgctgttctggccctcatcccaactatccacctgcccatctcctccctacctcctcgctgcctatctgcccaggacttatctgctgtctgctcacctgcctgcttgttgactgcttctctgccctcctatctgcctgtgagactagagatttgtcaccttggaaagcacggagagtactgctaagatgaaacacaggaaggacaggccttgatggaaggttggggggccgagagatccagagcctatgggaggggacttgtgagtgctggcatattcaggaccc

SEQ ID NO: 100769 - DNA, 264 bp, Homo sapiens
tgactggagataggtaggtttgtgtcctttgatttctccctagatgaagttgtaggtggagtaagaggtgtatcaggcagtccttgaaggagggggcatatgagtgctttgctgaattgggtgagaagagtgtttagaaaggaaaaagccatgagacagtattaagtcataaataaacaagaggactttgtgggtggaatggagctggagtatgaagggagaagaggagaagattgaagagtaacctgtgagagagggaaggat

SEQ ID NO: 100770 - DNA, 411 bp, Homo sapiens
caggccaagaagcagttggcatcgggttccatctgacttgatctatggcctaactaacctaaaataaagtttactttgctctgagcaggcccgattagtagagaaagccaattaacaggagcccttagcaaccagtcagggtgttctctgcagacagcctgagggaagagccctggtcagctcagagctgtcacaaggggcttgacaatggctctcctggggctcctgaaagtgggtgtccaaaagttacgagtgctaaaactacaaggtgcatgttatgcacatggccaccagagctacattggaacatttacatactgctctatgcagcctccaatcctggctctcccacggtgcccacaagctcatcccaaggctccctgccatacagcttcaccttccacctgccag

SEQ ID NO: 100771 - DNA, 349 bp, Homo sapiens
taaattcgcggccgcgtcgacattaatatcttatgtaaagaatccttgttaattataaaattgtgaccataatgaaataaaaataaaccactacaagtaaaaaacaatgcataaggtccctaattaatatcttatgtaaagaatccttgttaattataaaattgtgaccataatgaaatgaaaataaaccactacaagtaaaaaacaatgcataaggtccctaattaatatcttatgtaaagaatccttgttaattataaaattgtgaccataatgaaataaaaataaaccactacaagtaaaaaacaatgcataaggtccctaattaatatcttatgtaaagaatcct

SEQ ID NO: 100772 - DNA, 1485 bp, Homo sapiens
atttatagaaggaaaaagtatattttctgttgttaggaaagcattttccagtaatttgatttttctggcaccctaactaagggaagttggctttttaaattttactttgttgccagaagattaaatttaaggttgagttccactttgtttgcaatagtttgaaaaagaatagttaatgcagattttttttttaatttttttccttttaagctttgtgtcttgtacaatgtgagtttgccaaattttcttcatctgctacagattaggtatgccattgttgctgccatgtggcgtgcgaccccgtgcttcttaaacgcactgactggaggtttatcgcatcacttgttcacatgcacggagcctggtaacagcctcatctgtatcttgttagcttcattttcttatttttaaaatttcattatttataaactcaacatagcatttaaaaataaaggctagttttaattaattaatgttactacaaaaagtcattgctaaaattttcatagtgaaacagattttaacttttgttaaaatgtgctatgctttaattaaattgtatttactctacaagcagggatgttttacctgccattttaactgtatttgccaaattctaaatataattttgaaaattgaaattgaagcttatgtttatgtggcaaaagtaagcttcaggactgggctgtgtatttttattggcatgtaacagttaatatgagctctacaagaatttgtttttaaggagctaaagctatcaacagctgcagatttaaaaaattatatattaaaactgttaggttagctcagttgtacaacttagtgaatcttgtatcctgagtttctgaaggctggtggataggtatctctgaaatcattgtgttttagtctttttactgatagttttgtatagggaattcatcttctcttttaaaataacttttttcctttaatttatttctattacttattgtacataaattttaaaataaaaaaataaaagaaaaaagtcacttgtctatcacctgttaatagtttaaacattttggtttatttccattcatccttcccccccatgcattatttacatatttttttttctctgtaggcatattttaatttggatcacagtttactacttagtatctccttttcatgacatttgtaatttccctggtcattatttttgaaaatgagatttcttcatggttttatttcattttattttcatgcctgtgagtattttatcatgatggttgtcttcactctcctactcccaatgattcctagaaaagaaactttaaaacatgtttctacttcccattctgcagtttagtaaaatgatttggttaactcttaaaactttttgtggaataatgttctgtgaattcaagtatacaaggcaggaggatcacttcaggccaggagttccataccagcttgggcaacatagcaagacccctatctacaaaaaacaaaaagaga

SEQ ID NO: 100773 - DNA, 2046 bp, Homo sapiens
ataatgtaattcaactcttaaattatttcctgccttttcttcactcctatttacatgtgaaagcatgtgatcaattgttgctgcatcagatatgagagattcttttttattaggtgagcattatttataaactttgctatgaaaaagacattaaaatatgagatgtatgatgaaaatctaagtgaagagacttttatggttaacttataatattaagcaatgtgtgcgttaggcattcagagtaatattctgcattatgagaaaacttaatttcatttataagtaaattaaaattagtatattttactaatacttttatataaaatgcagtatattttttaaatttcagattatatgtgatgttaatatattcaacctttttaacatgttaaatactattgtgcattcagtgaagtgttattatgccacagacattaacctattccaccttactcaagggtgtacgtaaaacatggtaacagtatactatttggtaacataatggattaacatctctagtaatctcttttgctagtggctttgactgcaaataagttaaagaatattatttctgtaggttaaatttttgtttttattttattttatttttgagaggtagtcttgctctgtcacccaggctggagtgcagtggcacgatctcggctcactgtaacctccacctcctgggttcacgcaattctcctgcctcagcctcctaagtagctgggattacaggcacccaccaccatgcccagctaatttttgtattttagtagagacagggtttcataatgtaagtcaagctggtctcgaactcctgaccttaaatgatttgcctgcctcggcttcccaaagttctgggattacaggcatgagccaccgtgcccagccaaatgtttattttatttaaatttatttttcttaattatttggggtacataatatgagtatatattcatgcaatatatggcatattttgatacaagaatacagtatataataatcacatcagggtaaatgaggtatccatcacctctagtatttatcctttgtattacaagcaacccagttttatacttttagttattttaaaatgtaaaattaaattgttattgattacagtgttatttttatggtcataataaaagttatgtagaagtataataaaatccctacatttctgaggcctgaataagtatttttaaagttttctaatatttattttttgagcatgtttcctgtctgcctgcaaacacatgcagacatttagttttgatttacatatagttaaatatatgttagtctaaagataaaccttaagtgtaagaaaattatagagtgagtttgtgtgtatgaatttgtacctgttttccgaagaaaaaagcaatactgaacaaaacaaatcattttaacaagatgactactagaaaactaaaagcctcaaaaatgctaaaagaaaatgtattctctgctttgtattgaatttattactgtacattctgtggcttatagttctgaatctccccatgaaaattctgtttatacttgcctggtactcatgatagacccctaattattttgtatcttttttcatataaatattttacagattatgaagtattcattatgtgagctggtctgtgattataagaataatttttacaaaatttagtgcatacaaaatttttaaatgtaattccacaattagtgtattaagttacattttatttagttagaacacttcattttgtttttagttggagaactctatagccctttagttatttttcttttcactttttatagttgacataagtaaatttatttattgagtcaatttgttcaggtaagtactagggaagctttataagtcgtgaggatgtttttatatttaaatgtagcaaacatacatgacagttcttgctgtgtaacagatgctccatagtaagccataagtattcctgctaaagttagcttgtaacttcagttcagagatggaaaacatcagtggtgaagaaataaaattgattcttcatgtggagagga

SEQ ID NO: 100774 - DNA, 1184 bp, Homo sapiens
ataatgtaattcaactcttaaattatttcctgccttttcttcactcctatttacatgtgaaagcatgtgatcaattgttgctgcatcagatatgagagattcttttttattaggtgagcattatttataaactttgctatgaaaaagacattaaaatatgagatgtatgatgaaaatctaagtgaagagacttttatggttaacttataatattaagcaatgtgtgcgttaggcattcagagtaatattctgcattatgagaaaacttaatttcatttataagtaaattaaaattagtatattttactaatacttttatataaaatgcagtatattttttaaatttcagattatatgtgatgttaatatattcaacctttttaacatgttaaatactattgtgcattcagtgaagtgttattatgccacagacattaacctattccaccttactcaagggtgtacgtaaaacatggtaacagtatactatttggtaacataatggattaacatctctagtaatctcttttgctagtggctttgactgcaaataagttaaagaatattatttctgtaggttaaatttttgtttttattttattttatttttgagaggtagtcttgctctgtcacccaggctggagtgcagtggcacgatctcggctcactgtaacctccacctcctgggttcacgcaattctcctgcctcagcctcctaagtagctgggattacaggcacccaccaccatgcccagctaatttttgtattttagtagagacagggtttcataatgtaagtcaagctggtctcgaactcctgaccttaaatgatttgcctgcctcggcttcccaaagttctgggattacaggcatgagccaccgtgcccagccaaatgtttattttatttaaatttatttttcttaattatttggggtacataatatgagtatatattcatgcaatatatggcatattttgatacaagaatacagtatataataatcacatcagggtaaatgaggtatccatcacctctagtatttatcctttgtattacaagcaacccagttttatacttttagttattttaaaatgtaaaattaaattgttattgattacagtgttatttttatggtcataataaaagttatgtagaagtataataaaatccctacatttctga

SEQ ID NO: 100775 - DNA, 352 bp, Homo sapiens
gtgtcagggaggtggaggcccaggcctgccagcagggctgccgctcagggagctggggaggcagtggcagctttggcttgctctgaggctccagcccaaagatgtggaacagaacaggacaggagagtccctaggtgcctcggggtcagtcctcagaagtagccctggtgaagtggttaaagggggaagggcattaggcagagagaatgaccctgcacgaggcccaggtggagaggtgacccctgcatgtaggcacagggtcctgtggctagggctgagccacccggtgctgcgggtggacaatgtagacagggcttgatcctacaggtgcctgggggtgacccaggccaac

SEQ ID NO: 100776 - DNA, 794 bp, Homo sapiens
aggcaggagaatcacttgaacccaggaggcagaggttgcattgagccaagaatgcaccactgcactccaacctgggcgacggagtgagactctgtctcaacaataaaaaataataaagtgcttcattgcagtaactcaagtgtgtagggagaccctgggctggatggcatgcctgctggcagacagggtatgacccaggacccccaggtgagatgaacctgtcttgttgaattcccaagttaggagagttttcagttgttggtatattttgtcaggttagtaatctgaaatcatcaaattgctaatgtgcgaatgtgtattacttaccaaaatgtctatttttattctttttgaagttaagatctgaagaacagctcaggttcccaacattctcagagaataatgtcttgagaataagcaacctgctcttaagtaggtttgtcttgtccatagcagaatttattgccagtgccaaaaatcaattttggctaatacagcaattaatcaaaatttgctgtattgagtgaggtaagggcaattaggaaatcatgagttgggttttctatttgtttctgctgtcaagatttgtgttttcttaatgttgatttcttatttatggtgatgaggagggaggtgaaactatatttagttttcacaagtatatttgaaattctctggccaggaattcacactgggttcccaagcccgttgtgtgctgacaattctgacagagcaaatcattaatgctgatgtgtatttttgaggaagccacttccagggacacttagaaatgg

SEQ ID NO: 100777 - DNA, 214 bp, Homo sapiens
tatacacacagcattgtatacacgtacacaccatcaccatgacatacacacacaaccccagtgacacccagcattacacaaacacatccaaccatgacaacagaacagtacagtgacatagcaccttcacagatcttcccccaacacaacatcactctgacacatatacgatcccagcgtcaggacacaatcacatgggcacacacatctcact

SEQ ID NO: 100778 - DNA, 509 bp, Homo sapiens
acaggtgcccgccaccacagccagctaatttttatatttttagtagagatggggtttcactatgttggccaggctggtctcgaactcctgacctcaggtgatccacctgcctcagcctcccaaagtgctgggattacaggcgtgagccaccgtgcccagccagtgcctgccttcttttgctctgcataattattttgagacctcatccctgttgttgtgactatcaataaatagttcattcctttatattgctaaatagtatagtcacatcacaatttgtttatccattttttccagtttgtgactatcataaataaagctgctgtgaacattagtacacaagtcctttcagtagatacctaggagtggagctgctggtaggtgtacgttaacttcttttttttttttttttgagacggagtctcactctgttgcccaggctggagtgcagtggcacaatcttggctcaccacaacctccacctcccaggttcaagggatcatcttgcc

SEQ ID NO: 100779 - DNA, 192 bp, Homo sapiens
atgtgtttctcaattcttgccaatgatgtgtttcaggtggatttcaacactaagctatggtcagttgcataagacggctgccggttttagagacaacacgctgagttcctaagaagggctgggctcatgagactgggctctggagggcatggcctctgcaggtgactcagtgcggggctgaggcctggtcat

SEQ ID NO: 100780 - DNA, 285 bp, Homo sapiens
agcgtagcataggtattcagaatgtacaccaataatgagccaaaaggacagcttctctgttagatttgggagattttgtgtaggattatttcagataattaatgtgtagtcccatgaatcaagcagtgttacactgaaggtcctttgggttatagtaaaagctccatcgtggtaacctgatttttttttccaagacagagtctgactgtcgcccaggctggagtgcagtggtgcgatctcagctcactgcaacctccgcctcctgggttcaagccattcttttgc

SEQ ID NO: 100781 - DNA, 180 bp, Homo sapiens
gaaaacgttcagtaaaaatatggtaataaaatcttacgggaccactgttgtagatgtagtctgtcattgaccaaaatgctattatgtggcgcttgactgtaatttagctatttgaaggaagccaggttacacacacacacacacacacacacacacacacagagggtatatattgtataa

SEQ ID NO: 100782 - DNA, 407 bp, Homo sapiens
cttacgggtggggcctttgttccaattagtgtgtctttgttgtagcttcccctgctgaattgtagatgactgtactatggatgtttatgaagtccagaggggagtctcctgaccaggaagagttgcaagtacagaagtgcttcttcctttggggccccacaaccctaatgacctctttggagcttcagttctctatgactgatggtattgctgattggagcctcttgcaaaaggaagcagcattcacccttggagttctggactcacagctctgacgttgaaacaggtatattcctttaaagaagggtctcttctagttaaactgaatgcctggcccgtggagaccttgtaactcttttttttttttttttgacggaatcttgctctgtcacccagtctggagtgca

SEQ ID NO: 100783 - DNA, 750 bp, Homo sapiens
ctaaacgaccaccctctctgaagaccaccctctctgaagacgctgcactatgcctcagtgactgccccaagtacatttcactttgcaagttcttgaaccatctcactggggtaaggtttgatttgtctttttggatactatcatttctttcacaaatcttagagaatccagtgggccgaaattatttctgtgttctcccctcaataccagcatatgattgattgaccagcaatatgtctccggaaatggacactgggttggtttgaagacaatcttaacttctcaaagggtttgcttttcaaaggaagagtacaccaggagattcctctcagccccagggcattcacctgctcccttgagaggctacactccaacctcaggttgtcctctgtctcccattcccagataaccagagttcattccaggccaggagctgaaatttaccagagattctagcatacacagccacagtggatattttgatttatcctcagaaagtactgaaacccaggaccaaggaaaaaactgaagagtgactaaggacacattaccttataaagtttccaaagggaaaccttgacccaaaaatattctgataagatctctgtacctagggaagatttaaaaaaaaaaaaaaggcacagagattttttacaatacagcatcaggggatgagtctttggtttcttctcatgggaaatatttacaaacagataacaaatcttttttaaaatgccatccatgctttgt

SEQ ID NO: 100784 - DNA, 562 bp, Homo sapiens
tcccaaataatgatacttcaaaaattacacacatattttcttttgctaacatgagtatagtatgtggaagaaggagcgagttcatcttgtggagagaagtaaaaaggacaccctcttgagaacttttcatgtttctgcagataaatatctaataactaaacttcaacattcctgaaactttaattttaaacattcaaaatacactgagggaaacagataagagaacaggcaactgcaatatagtgtaaggagtgctatggtaggagaaaacatgggccccatgttggaaaatcttaactcagagtcaaaagtagtcatggaagagttcccaaagaagataacatgtaagctgagtcctgaaggagaaaaataatctagctacagaaaaaggtattccagttaaggcacagatattcaaaaaagcagaggtggctgggtgcggtggctcacgcctgtaatcccagcactttgggaggctgagacggccagatcacctgaggtcaggagttcgagaccagcctggccaacatgatgaaaccccgtctctattaaaaatagaaaa

SEQ ID NO: 100785 - DNA, 429 bp, Homo sapiens
acctccacctctcgggttcaagtgattctcctgcctcaacctccccagtagctgagactacagccatgtgccacggccagctaattttttgtatttttactagagacggagtttcaccgtgttagccaggatgggtctccatctcctgaccttgtgatctgcccgcctcggcctcccaaggtgctgggatcgcaggcgtgagccaccgcgcctggcctatttctcaatattttaaaaagcaatttcaataatatgcataatctttttaaaaaattttaacttccccagttttttagaagatgcataatcttatacaaatgcataaatgtccacatacatattgattttttaaagtattctttccctccccaatgtttttgttacttaacttccccattccctcttatcccttctgctacttccacttcc

SEQ ID NO: 100786 - DNA, 249 bp, Homo sapiens
ctattcttgtgaagagagaaagatacgttgttcttctgttttcacctttatgaaccatatatgtttctggttgaaattatgtgtataaacacgtgaacacatttatacattatacatatatgtgcatacaactatatacaaatttaggaaaagcatgtgcatggtgtgtgtgtgtgtgtgtgtgtgtgctgataccaccacatggattaaatctcaagattaatgtatataatcccatagagcccaaca

SEQ ID NO: 100787 - DNA, 383 bp, Homo sapiens
gggtgctctcagtatgaataaagcatttctttgcttgttgtgtattaatttagatcctcctccttgctcatttcatatttaaaactctcccattattgacataacaacatctctaaagcaattatttgtgattttcttttttatgtgacacagaattgtgaccaaagggggagtaaaccgcaaatctgattaactctgaagtgacaacactcccacatttcatgcacctgctggaacaatcaaatgatggagaagagggagggcagaaagcaggagtgcctttcaacaggaggcccgagggaaggtcgctgtgggtcactgacaggcaggcagacacccacagagaaatctgtgccagcatgtctagacatggcaggaaatgc

SEQ ID NO: 100788 - DNA, 750 bp, Homo sapiens
aacctgcgttagagtcacctcctccaactcagctgcaggcagaaacatcacgggaagtatttcaagagagtttgatggttaccaagttgattagaagtattaagggaaactgagactctgaagattcattttatcataaggacaatcatgtcctcccaaaaaacaagctgctatggcatctgctgtcaagagggattgccagatacaatataccctatattacagagtcgacacgaagttgcacattttacccaggccgatttctgagttacgggcctctgcagatgaaagaagatagaaagaaagcaaaatctatcttcacagtgcagtagacaaggagagagctctgcctaggaccaccaccatctggatacttgaacagaacgcaagctgtgcaacacttcttttaggctttaagatcaactgccccttttacagacttcacactgaattacctaagtccagcctcagagtcagacatgtgcattgggaaggggaggacagtggagtagccaggcaaggagggcagccaggagaaccaacatttcactattgaacatatgttcttccttgctctgtggctgcataattgtttctgttgagctctcatcacttccactcaaggcctaaagtgatgaaacaattctatcctggtttgccaatggcttgcattctagacttggtttctttccataaataattaacagtaatgctttattaaatagagtatggccttacttatgcttcata

SEQ ID NO: 100789 - DNA, 178 bp, Homo sapiens
aaaaggtgaaaaagaccaggcacacatctcttgcccacagggcactcaggctgcttgagtctcccctgcatccacgcactgagcattcatgtgatggaacatcagtcctggctgtctgcctgtgaggacacagcagggtaaccagggagaggcgtggaacaggacgtgcgttctggag

SEQ ID NO: 100790 - DNA, 1590 bp, Homo sapiens
gaaagattcatttattcattcaacaaacagtggccgaaggcttgttatgtgctgtgcctggacttggcatgaaggcaccagatgtcagaagcgaggctgctgcccaggaggacacacctgatggggctctgggaccaggacgatggtggagacatcacatccggaataactttgttaggaaggtgaacttgacagttaggacttagttctccttgaagacgtccttcacatccctttttcctgagctcgaactctactttttgcaacaagcagaatgtacacatgttaaacaagggcacacaagcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaatgcccatgaaggagtttcctggtttgttcctttggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgtgagagcaaccctgcaggaatcgcttcagtttcacagacctgacttcatctcccacatttgggagcggataaagcgtctgaagttaatagtccaggagagaaagctgcagagcatgttaaagagcgagcgggatgcgctattcgacattgacagggaacggcagggccaccagaatcgcatgcgcccactacccaagagagtcttcctggctgtccagaagaacaagcctatcagcaagaaggaaatgattcagaggtccaaacggacacacgcaggaggaacagtagcacaaaggcttcccggtgccttgtgggtgaaagaaaggcttccagggaaaggagagaaacacccagggatcccggtgacgtcgggaagcagcacccagaccatgtaaggacaccgcctgcagggggagactcaaggcctgggaaggttttctaatctgtgccttgagtcgggtggggggattttctgggaaaggaaaaccagacacagtaggacaaatattgtatagtttcacttatatgaaattgtcagaataggcaagttcgtagagacagaatgtagaacagggctttccgggggctggaggagaagacaaggagttcttgcctagtgggtacagagtttctgtttgaaatgatgaaaaacttctggaaatagattgtggtgacagttacacaccattgtgaacataattagtaccactgaactgtacacgttaaaatggttagttgtatgttttatgtattttgccataataaaaactagggggaaaaaaaggaaggggagattgtctcaggctggctgactttccctgcatgtacgcacatcttcacatgtgcacacatgtaaaacaaaaatgaagc

SEQ ID NO: 100791 - DNA, 751 bp, Homo sapiens
gcaggctttggtactcataattctttttagagaaggatttttaactgtttaaaagcaattgattccagttattgatctcttttctagacctgtgcacaatttggatttaataatctgtcttatgtaaattaaatgtggtggttttttttgttttgttttgtttttgtttttgtttttgttttttttgaggtgggatcttcctgtattgcccaggctggacttgaactgggctcatgtgatcctgcctcattctcccaagtagacaggattataggcacaggccactgtacctgggctctaaatgtacacttttataactgctagtttgggagtttttctctcattgaggagattgctttgtaatgcttccaatgttaagaatttttttgtacttttcttatcctagtctcttatgaaagaaagatatagtaactacttcatcaattttcatttttattactgactttcacatatcaagattcagaagttctttaaatatttaaacacgtattcttgtttagtccatatactacctcttttctgtcatttgaactctctctgcctcctaatatataggttatacagctgccttaaattagtgtaaagtaatacggtttcagtttttttcttgccgcatcttgtgcattctatcctctgtgttccttttgactttaaatggaaagagagcaggcgtatgcgccagcagcattatatgcctgtgactcctgagtagccttttccctctcctttt

SEQ ID NO: 100792 - DNA, 418 bp, Homo sapiens
caggtttaattctggcctacttaaacaaaggaataataggaagaaattttttctatatcttttagaattccctagtttgccttattttgttcatctttttttttgtgctgatagccaaatagttttctaagtttcacatgaggctgtggcagaaacacatgtgaatttggggagtgtctgggaagctgatgagcacatctatgtattggaccttttactctaaacaagcggaaaggatttctttcttttggccagagtacatccttctgttttcaagattttagttcactgcacattgtgtatttctttttagtaaacatttctttattgaaaaagtaatacagattcatatggacaacttagaaaatagaaaggcagaaagaaaggaacaaaaattgcccataaatgaaccacccag

SEQ ID NO: 100793 - DNA, 389 bp, Homo sapiens
atataaaaattagccgggcgtggtgtcatgtgcctgtaatctcagctactcggggaggctgaggcaggagaatggcttgaacccgagaggcggaggttgcagtgagcagagattgtgccactgtactccagcctgggcgacagagtgaggctccatctcaaaaaaaggaaaacattagcttttttactttcttacttcctggatcctcagagctaaacatgagtggagaacaggcggaatcacaccaaccctgtctttgtcacagcacctgtccctctattctacttacctgggtgtgtcttcccctttgccaggctgtgagctccttaagaacaggcagattgaccctttctttcctagcactgtgcccggcacagagctgctctcaa

SEQ ID NO: 100794 - DNA, 768 bp, Homo sapiens
cccatttcaaaactcttaatcacatcttttgacttataaggtaatatttacagattcaggaatgaggatgtgaatatctttgggggccattattcagcctgccatagatctcatgtggatttccagctgttttagctctttacactaaatgatccatcttttctcactgatattcaacatcagctctctcataaatcaaatttacataataattttatgttcacattatagtatatgaacgcatttgtatataaacacaaagacacttgcagattaatcttatttgtgtctcaataattcagtaaggtaggctggaattattatctttattttacagatgagaaggctaaagcttagagaatttaggtgagttgtctgtggggcttcttaatccaagatttgaattctaggttgtgacagtcctggtccctgtcctgtaccacactaccccataaagacatggttccgctgaaatagtgcaacccatattccattcttgtaactctcagaaacagtcaggttcccagcccatccagaaactctatccagtttttctaaaacattttaaaacacctatataacaactcatcaaagattcctgtataacacaaggcatttaaaatattcaaattacctctataatgcttaaataagtaagtatataaatgggtgtattggtttgtagcacgtaaagatactgtacaattttagacatgaattacattttctttctgcactgctgtaaacatgaactgtaatacaaacaat

SEQ ID NO: 100795 - DNA, 443 bp, Homo sapiens
ctcttggcttcttgggagaacaaattgtaggagagcaggaaaagaaacatggagacagatgagagcaatgtgacgtggacagtgttgatggctgtggagatgcagagacatgagatgtgcaagaggctagaagaaaaaatgaggaatgtgaaggcacatgcttggaaagtgaaaagcctactggaatgaaaagggcatcattggctactctgtgaggactctgaactggaaatcatccccaccctgggttgccacagcaaatgtttaatctcaggctagtcttcccttgtagctgccctgcatgccttaccacgactcctgcccccacaccccagtcctcatggtgtgcctcaaatcttaatactagtctgagctgaataaaacccgatgctggcccgcccacatccccctactactactaacacccgcccgaccgctccata

SEQ ID NO: 100796 - DNA, 747 bp, Homo sapiens
  misc_feature (2)..(3): n is a, c, g, or t
  misc_feature (26)..(26): n is a, c, g, or t
  misc_feature (94)..(94): n is a, c, g, or t
  misc_feature (227)..(227): n is a, c, g, or t
  misc_feature (319)..(319): n is a, c, g, or t
  misc_feature (378)..(378): n is a, c, g, or t
  misc_feature (387)..(387): n is a, c, g, or t
gnntttcctacaagcacagagtttanttttcaagacgttaaaaaaaatctgtcccggcccaggggactgaacatcagaagccagcctgaccagncacgtgtggccttggggcaggtccactgctgctttcttgcccagctagcaagcacaccacccacctcccgcatcaaatgcccaccccaacccaactccctgccgccgccgcgctgctcggggagtgactccanggtcgccttcgtggagacatgggtagtctgagggggaaggccacgagatccagccagatggtttaaaaattcttaaggaactcttcagccanaattcgggcacgggcattgactgacagcttcatctcactgatctccttgtcaatctccnccatgaagnggatcacaaagtccaccaacttgtgtttgtacatctgcctgctctttcttacctccatgccttttaaagatgttgtctctatttagaatatccttgccttgctgcataattccatatcattatgactcatcattatgactcagcacagattgcattgccttcccagaaactctcagaccctatcctaatgtaagctgctgtccctcctctgtactcctaggctctcttctctgtctctctctgatcttactacatgatttggtcattctttttatgtttaccacattaaattgccaatatttgaccatttttgccctacaagaacaatttcttttttcttttttgagatggaatctcgct

SEQ ID NO: 100797 - DNA, 486 bp, Homo sapiens
gcaccctgcacctgcctcctaacagccctcttcacccagtgtcataacagcctgttgactggggtatctctcccctagactccaagctctgaaagggcagaactgtctgcttagtcaccaatatctggggcacatacttgacacaacataggtatttattaagtgaattaattaattagttagtaaaggagtgagtgaatgaaacagaatggcatgccattggtagacacacaggatttcatatcagttaaagactcttcctacctcagcctgactcatcattttactgaggaaaatgatgccttagagaagtcccatgatttgcctcaggtcacacacaaacagatattaattgggagagggtgtgtcttagtctgttttgtgttgctataacagaatatctgagactgtgtcatttataacaaacagaaatttatttggctcattgttcttgaggctgggaagtccaagatcaaggggctgcat

SEQ ID NO: 100798 - DNA, 434 bp, Homo sapiens
gcggccgcctactactactaaattcgcggccgcgtcgacaacgaatgtaaaatcctgcaatatccttgaaatccaaaagaggtccatgacatagacccaaaggtattcatgagttattcatttaaatgcctggaactgacttcttgataaaaatataaaaaataatttccatgtaagttaccagaaagcccaccagcaacataattttaaagcctttcagattacttttaaaaaatgcagcttacatataacaacttgtgcctattttatttctaatctatcacttcaaaagatggtaatctttcaactcattattcctccaatttttaatgtcgaatttttttctaacacaataaccaaaagcttttatttataaaaaggcttgaaaaatatagacaatctttaatgtattatttgtaattatattctacctg

SEQ ID NO: 100799 - DNA, 353 bp, Homo sapiens
gaatatctaaacttccatctcaccagctttttgtctcagcgtctagtttgtttgagccataccttttttctataactaactttaccatttcaaaggggtttaacttttaatggcatggtgagagcatgaagaacctcagccctccaagagggtgaatgtgcaagatttggagagtataggaaataactcactctaaaattgaaaccaggagagtggaagaaaattgaagtaatgaccaggcgcggtggctcacacctgtaatcccagcactttgggaggccctggcgggcggatcacctgaggtcaggagatcgagaccagcctggccaacatggtgaaaccctgtctctact

SEQ ID NO: 100800 - DNA, 793 bp, Homo sapiens
aacaaacttgacatgttctctttacctcatttcccaaggtgaaataatcacaaaatggtaagtagctaagctttcatcatgccaaactgctgaggagagatccatgggagaggtgttatggacaaacaccaagcaggcatgcgcccaaaggaaaaattcaggtagatgtttgtatcatttttatgttactattttcagaaacatgcctgattttaagtgactctacttacattctactgttcagatgattcttatctaagtccagagaatcatatacagtcactggaaacagctcccacatcaatgtatattgaaaaatgactgttaaattatgtacacaataccgtgctccttgtgggatctgggaagaataaaaaaatatgtacacaataccgtgctccttgtgggatctgggaagaataaacaaagtcttcttttgcttctccagccagcacaaccaaatatcccaaatctacatagtttttctcccttcttctccctcaacctcaattagatctatgtctgtttgtttgttttaactactggatttaaaaagtgcttccagaatacagtactagtttgacagtcgctagcagagttgattacacattaaactaaacatagatggatatgtcctctttcagacagctaaaattaccttttggttgggtgtctgttttggaaagctcaatttcagttccagcaactgtacacctgaaaatgcaaggcatacccattaggaacaaacagtactttttctctatttaaaccctgatggccttgaggaggcaaa

SEQ ID NO: 100801 - DNA, 118 bp, Homo sapiens
ctttgccctgggttggtcctggctgagcacccacaccctgagccctgctccaggaatgtctgcagcttgtcccacagctggccatcaatcatggatggaagattcctgccctggcatg

SEQ ID NO: 100802 - DNA, 675 bp, Homo sapiens
gggagacattggacaggacagctctgatgatattcacagcgggactcttggcctgtccctcacatccgatgcaccctttttgtcagattatcaggatgggggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagatttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaagg

SEQ ID NO: 100803 - DNA, 406 bp, Homo sapiens
tcggtcggtcccgtgaggtacagctgaaccaaagtcctggaatatgaggagaggagaggccagaacaggcctctggggattcactaagtgcatcactccaaggcccaactgaactcagaccagtaaacatcccatactctgtggcaagtctgcagaagggaggatgcagcccctgtcctcagggaacatacattctaacaacatatgacataatgtgcccataacagagatgctttgggagccaaacaatgcaaggggcaaacccacgttcccagaggaactcactgttttggtgacttttcttccataaaattgtcaggaaagggcaggctgtaagatagaccttctgtctggagacaggatacgtcaaggttaggatcacaagccagagtccagctacccaggt

SEQ ID NO: 100804 - DNA, 223 bp, Homo sapiens
tctcccaaacctacaccactaacccagtgcccacccggccattcaggtctttgccctcatccctaacccatcaccactaacccttcagtccacctgcccctttctagctgcaatttgccctttggccaacctgaattacatggactcactttataatcacttattttgcaaatgaaaatacttcttggccgggtgtgggggatcatgactgtaatcccagcac

SEQ ID NO: 100805 - DNA, 569 bp, Homo sapiens
agccgagatcgcgtcgactgcactccagcctgggtgacagagcgtgactctgtccccctccccccaaaaaattatagaactttcccacgctggaaacaaatcaagggtcctttaccagataaatgcataaacgaattgtgccatattcaaacaatggaatgcatttgagccatagaaaagaaagaactaatgttacatataacacatggataaatctcaaaagcattatgctaagtgaaaacagccaaaaacgaaaatactgaatgatttcatttctatgaaattctagaaaaggcaaaactagcgttagaagtcacttcagacattgcctgtgttgagagtgagacattatctacggtaggcatgagagaacattttgaatgaagggaatattctacatcttgatagtggtactggccacattgaattatttccttatatttgttgaatttttacttatatgtaaattccacttcaatcaagctgttaaaaataggaatgtgagaccaggcacagtggttcacgcttgtaatcccagcactttgggaggccaaggcgggcagatcacc

SEQ ID NO: 100806 - DNA, 226 bp, Homo sapiens
agataacagaaaaaaaaataaaatagcatgcaattaactaccagctggcattaaaatgtcaccctaaacacagcagtcactcaatgaatgtggtttatgaacaatcttccttgacattccactctcttctgtggggaaacttgccatacttttctctgattccaaggaaaaagccaggaactaaataaaagggccaccgagaaggcagccttttattggctttagt

SEQ ID NO: 100807 - DNA, 112 bp, Homo sapiens
gtgtgatgactccctccccagcaggacccactttatgcatacagtcaactggccacccacacccgggcttgaaggatgctggcatgatctccccagcaggctcatcaccaca

SEQ ID NO: 100808 - DNA, 514 bp, Homo sapiens
ctttatatattctaatgagtactacctttgttaacgcagtcaagtttgcaagctgtacacacatttctgagatactgacatagctggaacaattgtttgaagggcctattaaggtcctaccttcaaagcccagtgcccgttatgcagaagaatatcatcaaaagtggttaatctgactttgaagagagtattgtatttttgagaacagttaaaaatcatttagaattaactgacaaattaagcagtttatttttcatctgaaacaaagtttagaaagcattcacaaaactgcttttcttctatcaccataaatttaaggacttattctaaagaaaaagagttccgtaaatgagcaatgaaagacgctatgatctcccaaagtacatactgtgaagggaaatattcttagtaatgtatatttggtgtatttgtgaaacacacacacacacacacacacacacacacacacacacacatagctacacacaacaatctctcacccccatctcctctg

SEQ ID NO: 100809 - DNA, 377 bp, Homo sapiens
cctccatgtgcaggtgtgtgtgggctgggaaggtccatgctggggctgtgtggtgggcacagaagtcaaatactggaagggggctcaggagaagctgcgacctggtcccgtctccctgacctcaggcagacccagggtttcaaggtgacaaggtccacgggaagtggcggggctgggggacgctgtgttaggaaatgaggttcacctgcctccctgtcttgcgtgtgccctctggtgggaagcagatgcccccagtgaacccagaggtggtcctggttttgttgtctttgttttttgttgttgagacagagtcttgctctgtcacccaggctggagtgcaatgacgcagtcttggctcactgaaacctccgcctcca

SEQ ID NO: 100810 - DNA, 700 bp, Homo sapiens
gtggagaagccaaggccgcacactgtgtttcaaatgggaggtcgagaggagcatcagggtttaggccgggaagctgtggcagctctctccacagttccaaattcccaaagggacaaagctctgcagcgacaggaaggcagatccaacttgagacattttcctttatgacagggcagaaacagtagtgcagagctggagaagcctttattttagggggtgtaagaagtttaaatgtggtcaatctatctgtgagctgcaaattagtctagggatctaaatttagtctcaggtctaccaggtatctcaagacgccaagatgactcatgataaatcccagccttagtttgtccctaggcctctagagcaccacagttactggaacttcacaggtgcggccactgcgcacaccttcctggaagcaggcccagccccacacgccatgttctcggaggagaagccttctctgagatcctctccttttgttgagaaaggcctggctagagtgctttgtgcaggatggttccagtgcctacaccctaggtctgagaagccacatggctcagtgccttcaggacatgccctcccctcccctcctagtgtcgtttctgctgagcagctggtcgtaaggacccgggccttcagctttccccgcatgctggctttccaatttgacatcactgaccaggcactaagagattcc

SEQ ID NO: 100811 - DNA, 801 bp, Homo sapiens
agcgcgagattagagctcctgctagtccccagctgaccctgggcctcaaaggcaagccctgacctcagtcacacggggtggcggtgatatggtttggctctgtgtgcttcactctgcctcactcgccttccgcctgctggacgctgccctgttccccgcaggcggccgccgtggagggcaggcaccgcgctccctggctgctcccggggccttccaagcacagccgcggccatggggccgaaacccagacctcgaggggcctgcgggcggagctccacaagcccagctgctacactgaagggaaaaacctgaggaagcccctgaccttcttgaataacctggatattgcagaatcatgcctggcacacggcactggcagagacgcagaagggaaagtgtccagcgatgagagataccggccagggggcaaatcttcagcttgcagcactcactttgcagatccagttggaattatttgtgttgacgctctctgctctctccgctctcccctggaaatgacgaggaactgagtacagtggacaatggcttccgtgtccctagctccccccgagccatgagctgctacatcaaaagtctgcagtgggctgcccttcccataatatttcaatttaagcaccgacttgctgctgcggagtcatatctcattcatgctgcagcctttgcaggagtcagggatcattatggagcaagcactgagaaaaaacagattacagcttggcaccgagcagccaggttgcaccccagatgcttcagggacatggtgcctgctctggagaatgg

SEQ ID NO: 100812 - DNA, 282 bp, Homo sapiens
tggggaggggtgggccactgggttggtgggggttacgcagacccttggcagctgctgcatttgtccagggactaaggagcaaggctgtagatgagcctgtgggctccttaaagcagggactgggatgacaagtccccatctccagcccctgcagggtgctgggtcctaggaggggctaaggaatgatgggtgtgtctcattcctcctgcacccttcctgcttgcccagggagaacaccaatgcctgctgatatgtttctagacgcacccaagtcctggacac

SEQ ID NO: 100813 - DNA, 415 bp, Homo sapiens
gctgaaatattgagatcaaaaagtgggtaattagctgagactggtttggccagctggcttggccagagaaactgaatacagcaaaggcatccaaaggtccttggatttatagctccatgtgggaagggaagtcaattcctgataaccatgatatgttaatcccactggtaaaaactccagatgacaaaaaataatgcaaagttgggaagaactgaaaaatgtttccaattcatgtttgtagttttttctataactaggagtttcggaagcaggactaagactcctgggaagaagggctggcaaaagggaggtatattttggggacccagatatgcacactgagatttaaagaagaaccccttgcagtataggtatgtgtaacacaaagtcaccaaagaaaaaaatatccatttcc

SEQ ID NO: 100814 - DNA, 280 bp, Homo sapiens
tgcctgtgcttgcctctctcacggagaaataatttctcagaattgctgggtgtttaaactctaccatggtcaaattctccacacccctgtttcagaatgttgtctatctttttgttttttttggttctagcttctatacacctaatgctgtctatttagctatctgggcttcctcccaaatttgagaggagtgtgagatggggtagaaagaaggaacagggctgggcgcagtggctcatgcctgtaatcccagcactttgggaggccggggcaggtggac

SEQ ID NO: 100815 - DNA, 437 bp, Homo sapiens
actggagagaggacctggggaggaggaggaggacagatgaagttggtgactgtaccttcatggccatagctgggttctcagcacccggggatctgctgatcacctactcataggccaggcccctatcgaagttctaggtgacccagtgctggggacgggggggccacctgcaaggtctaatcatggaggtgggggctacagtgttggcttgtgctggggccagcatccttaggaaggcatcttggaggtggaggagacagccgcccacttcttgattggggccttcagcagcaccagcttcttgggcaggctggtgctggctttcatcaccatgtcgtgttcaatcttcttccagatcctgacttctaggttcagctttcctcagaccctggttcctttcagaggccattgctgctgccttgctctttgctggcttg

SEQ ID NO: 100816 - DNA, 293 bp, Homo sapiens
tggagctgggacacactttttctcctgcctttaagcattagaactgcatgttcctttggactccaggacttaaatcagtgtaccctctcagccccatgttctcaggcttttggccatgcagtgagagttacaccattggcttctctggttctgagaccttcagacttggactgagccctactgccagcttccctggccctccagcttgcagatggccaatcactggacttctcagcctctataattttgtgagctaattccctaaaaaatattctcatatatctttatgctgt

SEQ ID NO: 100817 - DNA, 418 bp, Homo sapiens
tattttgagatggagtcttgctctgtcatccaggctgcagtgcagtggtgcaacctcggctcactgcagcctctatctctcgggctcaagcagttctcctgcctcagctgggattacaggcgcccgtcaccacgcctggctaatttttgtatttttagtagagacagggtttcaccatgttgacgaggctcacctcaagtgatcctgccaccctagcctcccagagtgctgggattactggcatgagccactgtgcccggcctcaggccagtatttttaaatatcggttaataattgcaggaaacatcatttcaggttgacttttctcacctttaacctctttatatagcacagtgcaatctggccctactgccacttcatctgggttatctgtagcttgagttgtaaaaaaaaaaaa

SEQ ID NO: 100818 - DNA, 685 bp, Homo sapiens
ctctcagggtagctccagctgtccctcccgcagttggccctgtggtgttccgaagccggttacgtacggcctgagggccaggcgaacctcaggctctttgtcctactaaaaagcgcagcacaatggtagaagcagatcgtcctggcaagcatttcattggtggcctaaatagggaaaacaatgaaaagatgtttaaagcagtatttgcgaaacatggtcccatatcagaagttcttttgataaaggatcgaaccagcaaatccagaggctttgcatttactacttttgagaacactgcagatgctaagaatgctgccaaacatatgattggaaagcctttggatggaaaagcaataaaagtagaacaagccaagaaaccatcttttcaaagtggtggtaggcagagaccaccagcttcctcaagaagcagaagcccttcaggatgtctgagatctgcaagaggaagtagtggaggaacaagaggatggcatccctcacatgaaggacgcttgggtaatgttttaaaatgtaaagatggaaccataggactgaaagaaaataagtttgaagatatcgaaatttctcaattatatttatttcctttatgaacagaaaattgacttataataagcaaacttatttctaagtactaaaggtgtattacaagaatgattgaagtaatatc

SEQ ID NO: 100819 - DNA, 401 bp, Homo sapiens
atccctctctcacgatccttccctctctcaccctgaataatctataaagtatctatgccttgtgcatgcctcttgcgttgcatatgttggttacattatgccatcattttttgtctacaagcaggcaggcccctactggactctatacttctagaggatgatgactcacaaagagcttgcacatagtatgtactcaatacaatttgctgaactgagcccaagcatctcagaaaaaatccagcagttaattgcaaagcatcaaagcacttggagtctcaaaaaaaaaaagtttagcaatttcttttctaggctacaatatcacctagcattcagaaattataaagaaatttcatcctgctttgccacaaagaactggcacagtaaccccgtgagagagggaa

SEQ ID NO: 100820 - DNA, 456 bp, Homo sapiens
ccctgggaatttgcccccacacagaatgcctcttgagggacttgctttatgagttctgatgtgcatcttcctcttttcttgctgtccgtggtacttctctttgtcccctcttcatttctaatctgacacagacttagaggaatctttttgggtgaggtagggcttagacattgtggctcagagtgtaggccctggcgccaagtcccagccctgctgcacatgctgtgtgacacgggccacgtatctaccccgtcaggggaccgccatggtggctactacacgggggcgtgcatgtgtgtggattaagtgagatcatctgcgtaaaatctcagaggagtaagtactacaaagctaactattcaatggttaaaccaatggttgaaaaatatttcctcccagtgtgtgcatatgggtgaggtgtggactctgcagagaaaccctcctggccacccctgg

SEQ ID NO: 100821 - DNA, 239 bp, Homo sapiens
tatatttggatgtggcctactgagattttgagatcagttgtattgcagccaatacatggttcatatgggataaggagggaaataatcttaaaattggccaggtgcagtggctcatgcctgtaatcctagcactttgggtggccgaggtgggtggatcacctgaggtcaggagtttgagatcagcctgcccaacatggcgaaaccccatctctactaaaaatacaaaaattagccaggtg

SEQ ID NO: 100822 - DNA, 1124 bp, Homo sapiens
cagggataagctttttgttttttgcctgtgagttattcttggccttgtttttcctgctgcttccccttacagttgggtcttacaagccctctcacctacagactccaatctggcccaggtcctgagccacacctaagtgaagctatgtaattacaccctttctcacctctccttccagtcatcaaagtgaggcatctggagccagccaatttagcatcccagtctctggggcttcaagtgtatctcatctcggaggcctgccatttgtttcagggtcttgttggcagcagttgggctttgcaaaactctggcccgaccactcttgctttcctgccttggtttctccacaagcaaacctgccacacctcacaacatcatatgggatttgggtccgagtcttgctgttatatcaccacctgggtcatctaggcttgtcactgaattgttctgaaacccagctttgtttctcacccactcccaagctcctctagctaactgaagaactggactaattccctggtattaaaatctggcctcacgtaagagttgcttggggaacttctctaaaatacagattcctgtctccctttagccgaggatttttgattcagtagatttcagccacttaatgccctaggtgtcattgtctcactgggttagtagagccttgctccctgttctggtacctctttgttctctctgcttgttgatgacaatctgaacactgtccttcaatggaggtcaaagccctaaacaagatcctttctcctcctcaggggaagagctcctcattgttgggagagaggcctgttctcagcataaggaagagaatccattctttcttatgcacaatttctgctatttatctcgcatttggtaaaaattcagactgtgctgtctgccacaccgctgctattggttagccctcttctctttttttgtactcaaggcaacttccctacctttttcaccgaaatactgatctcaggggaagggaggggttactgctgtatcagccacaacctttgcaatccatagattctccatcaggtataaccaagtgttttaaaatcagtccaagaagcgaggtattttgtaccttattttcatcatttaaaaaaaaa

SEQ ID NO: 100823 - DNA, 961 bp, Homo sapiens
  misc_feature (953)..(953): n is a, c, g, or t
acgcctgtaatccccagcactttgggaggcccaagacgggtggatcacctgaggtcaggagttcgagaccagcctggccgacatggtgaaatccccatctctactaaaaatgcaaaattagtcaggtatggtggcatgtgcctgtggtcccagctgctcaggaggctaaggcaggagaatcgcttgagccgaggaggtggaggttgcagtgagctgagactgtgccactgcactccagcctggatgacagagcgagactttgtctcaaaaaaaagttatacgtgaaatgtgaagccacagtcttggaaacacatagatccttggggagcaactacccacaaaagaaaggaaaagtgtcctttggcatttgggtgtgaagagagaggcaaatggagaagtttaactgccctccaagacaaaaaaaaaaagaaggcccacaacccccacccctgcaaaaacaaattcactaaagcatctggacttcacaatgttgccagaagagggcgtgttatctagggatcttgtaaaacacccaataccacaaaaatgaataatgaaaagataggttcatacagctattgcaaaatatcagaaaatgaatttcatcacatatgaaccaaggaaaattcacacaaacctctgaaacaatagccatgaagaagaagaaagctgtaattccagcactttgggaggtcaaggtgggaagatagcttgaggccaggtgtttgagaacagcctgggcaacatggtgagaccctgtctctacaaaaattaaaaaaaaaaaaaagaaaaaacacaacagccaagtgtggtggcgcatgcctgaggtcctagctgctcaggaggctgaggcaggaggatggcagcttgagcccaggagttcaaggttgcagtaagccatgatcacaccactgcactccagcctgggtgacagggtgaggccttgtatcaanaaaaaaaa

SEQ ID NO: 100824 - DNA, 498 bp, Homo sapiens
ccctaactcctagggaccactctcccccagttaactacagcccgcccacatccaggcgtttgccatttggggagcccagcctcccacttccagagacaatcctgctctaccctcagcccacagctccgagggctggcccgcctctctccctgcctccacccccttccaaactctgggcgggccctggcacctgtcaggccaatgcggggggcggggagggggttgggggggtcgggtcggccccctcccaagtgcgtctcagctgccaaaacgcggagcccccacctccgcagcaaggacacgctcagagttggggcagggaagaaggtctgtggtgcaggcgctaaaaactcaagtcactcaaggatgaccccttttcagtcccggttctcaatttcaccttctcgcaggaaagccccgcgtctctattaacccttccatcaccgctgcaccgcgagagggaccggagaagtcttagcactgcgcagcagcggccgc

SEQ ID NO: 100825 - DNA, 1328 bp, Homo sapiens
ttttttttccccaaatgctgcacgtagcatccaaaagtagtcttttttgagagagtggctagggacattaggtaaagagaaagcaaagatactttattgaggattaatttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctcaaaaaaa

SEQ ID NO: 100826 - DNA, 3176 bp, Homo sapiens
  misc_feature (377)..(377): n is a, c, g, or t
gcacgaggatctcttcagaactatatccaatggtacctcagctgttgtatatgagaccctaaagctcaagttgaggagaagactagctatgggaaaaaatgtttcaaaggctgttgagcacatcaataaaactattgagcctgccctgattagcaagcacctgaatgttatagaacagaagaggattgacaaattgatgatagagacagttgaccctgacaataggtctaaatttggagtgaacattatactgggaatctcttttgctgtttgtaaggctggagctgccgaaaagggattctccctgctgtcacagaattgtgaatttgctggcaattctgaaggcatcctgctagttccagctttcactgtgaccngcaatggttctcaatctggcaataagctggcagtataggagttcataatcttccccgtcagcaaacttcagggaagccatgctcgttagagccaaggcttagcacacttgagccgtgtcatcaaagagaaatgtgagaaagctgctgccaatgtgggggattgtggtaggctgcataatgtctcctaaagatgtccatgtcctaatccctggaacttgtgaatatactactttacttggccaaagggatttgcagatatgattaaggttatgaaccttaaaacggggacattatcctgtattatccagaagggtccagtgtaatcttatgagtccttaaaagcagagaagaaagccttttatgtctgtggtcagagaggtcagaagttatgatattgctggctttgaagatggaagagggggccatgagccaaggagagtgatgaccttgcagctgagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctcaaaaaaa

SEQ ID NO: 100827 - DNA, 383 bp, Homo sapiens
cattccaaatttcagcaatccacaaaccttgttgactcttcccggtgtgaacgttcttgtatcttttccttcctttccatgtacactgtctaattaagcctctccacacctcattattaataccaccaacagcctcttcaccacagataaatattcctaacataacactgtaatcacatcaaatccctgctcaagagccttcaatgacagcccacagaaggaagccaaagctacacccttaggatagatagctttcaagactgtttcatttgggatccaagttaccttccaggcctatcttcgtaaggctagaagtatatctgaatcaggaaagcttttagaaatatatcccactttggggatcacttgagcccaggagttca

SEQ ID NO: 100828 - DNA, 337 bp, Homo sapiens
acagagtcttgctttgtcacccaggctggagtgcgatggcatgatctcggctcactacaatctccacctcccaggttcaagcgattctcctgcctcagtctcctgagtagctggggttacaggtgcctgccaccaagtccagctaatttttgtatttttagtagagatggggtttcaccatgttggccaggctagtcttgagctcctgacctcaagtgatctgtccacctcggcctcccaaagtgctgggattacaggcatgagcaatttgaaggagaaacagagcagaagcgacacctgttgggggttgtggatctgtttgtttctgcagtcagag

SEQ ID NO: 100829 - DNA, 654 bp, Homo sapiens
acagggatgaggaaacctcatgaaagcagttggagaattttgttggcatgtgaccatcatattttctaaccatgaaaactgagtcacagagcgccacgccccagtaagttggaggatacacgattaaaacactgctgaatagcggggaacaaaaggcaaagtgctgggattacaggcatgagccaccgtgcccagtccatattctattctacaagaaaatgtattataccagaatgggaaggaagtcacaagtgagagaaatgttgctgaagagaagcctggattatttctgatgtgtatgaagtatctatatccatgtggccaccaacagtttcaaagcttgttctgatgcctaggatactaaatttgggtacataatttgtggctattcagaaggtttatgggactggtgtccgtgagtgacggatcgttaatcttcagtagacaggtagtaacagtacgcatgtcggtagaagatcaaagttcccacaggtgacgagtgattatccattttatgccgcataggtattcattatatagttaaaatctacattggtaagggatacaaaatacccaacagagaggaagaagcacagagcagaaatttggggtactttgcatgcaagttgtaaggtctgtggggttctatactaa

SEQ ID NO: 100830 - DNA, 4812 bp, Homo sapiens
  misc_feature (3789)..(3789): n is a, c, g, or t
  misc_feature (3957)..(3957): n is a, c, g, or t
  misc_feature (3998)..(3998): n is a, c, g, or t
  misc_feature (4000)..(4002): n is a, c, g, or t
gagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgcatactgcattcccccgctctttcggatcgctaagcatgtttcatgagggtcgctgtccccgggtggaatgcggccgtatgcacgcgcctccctgcacacgcacacacacgcacacttacaataagtgtctgcaggaggagtgtcctgcgcgccagctctgcgtttaagacaggaagctgccgggttaccgagtcaaatgggagtgacactattcctctccatcagcaaggaaagcggaccacaaaagtccctttgtatctcggcagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgggttcctgggctcccgcacccggagcgggggacgcggccgctttaaggggaggaggggcggcgggctgctcctgtcacccagcggcggccggagcgtcacgtgggcgcgcggcgccgcggccattggcccgaggcacgtgtccaggagaccggcctgcgacgtcactcgagggggctctgttaaaaataagaacaaaaatccagagtgaaagtgtctcaggttgcgccgagtggcctggaaatttccgagcccgcgcggaggccgaggcggcgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggaggccaggtctcagtccgcgctaaacaatgcaataatttaaaatcataaagggccagtgtataaagattataccagcattaatagtgaaaatattgtgtattagctaaggttctgaaatattctatgtatatatcatttacaggtggtataaaatccaaaatatctgactataaaatatttttttgagttttttgtgtttatgagattatgctaattttatgggtttttttcttttttgcgaagggggctgcttagggtttcacctttttttaatcccctaagctccattatatgacattggacacttttttattattccaaaagaagaaaaaattaaaacaacttgctgaagtccaaagattttttattgctgcatttcacacaactgtgaaccgaataaatagctcctatttggtctatgacttctgccactttgtttgtgttggcttggtgaggacagcaggaggggcccacacctcaagcctggaccagccacctcaaggccttggggagcttaggggacctggtgggagagaggggacttccagggtccttgggccagttctgggatttggccctgggaagcagcccagcgtaccccaggcctgctctgggaagtcggctccatgctcaccagcagccgcccaggcccgcagcctcacccggctccctctcctcaccctcctgcacctaactccctcctccttctcctttttcctcctcttcctccttcctccttcctcctgctcctcctttcttcttctttttcttctcctcctcctccttccttcctcctcctccttctctttcctcctcctcctcaccaagggcccaaccgtgtgcatacatcgtctgcgtctgtggtctgtgtcgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttggcttggccccaggaatttcctgtgactccaccagccatcatgggtgccagccagggtcccagaaatgaggccatggctcactgtttctgggcnggcagaaggctctgtagagggagatggcatcatctatcttcctttcctttttcttttcttccctatttttttctttttttcctttatttttttcttttcttggagtggctgcttctgctatagagaacattcttccaagataaatatgtgtgttacacatatgtctgnatgcatgtgaacacacacacacacacacacacaccaggcgngnnngagtccacagttctgaaacatgtggctaccttgtctttcaaaagaactcagaatcctccaggatctagaagaaggaagaaagtgtgtaaataatcatttcttatcatcactttttgtcttttcttgttttttaaaatatacattttatttttgaaggtgtggtacagtgtaaattaaatatattcaatatatttcccaccaagtacctatatatgtatataaacaaacacattatctatatataacgccacactgtcttctgtttagtgtatggggaaagaccaatccaactgtccatctgtggctgggacagccagggggtgtgcccacggctgacccaggggtgtgcacacggctgagctgggagtcccgctggtctccctgaggactgagggtgaacttcgctctttgccttaaacctctttatttcattgcagtaatagttttacgttgtacataatagtgtaaacctttttaaaaaggaaagtataaaaacaaaagttgtaatttaaaagtctgaataaccatctgctgcttaggaaactcaatgaaatgacatgcctttttagcaggaagcaaagttggtttctgttttttgttttctttgttgttttagtttataaaacatgtgcattttacagttccagtatcaaatatttataatcttatgagaaatgaatgaatgtttctatttacaactgtgcttatcaaaattgtgaacacccccacccccgcatttttgtgtgttgaaattcttgaaggttacattaaataaaacaaaatctctttattataaaatactgaaggtcc

SEQ ID NO: 100831 - DNA, 638 bp, Homo sapiens
catttcactgtgatcaaaaagtttagcctttaagtaattattgcaaaaaaacaaatttactcatttattttacctttatttgttaatctcttattataaacattagctaagaatgcaattacagagtgaacataaacagctcttttataattttaaagttctgctgaaatatgttaggaataatataatcatatgagcaaataaagatccatacgtcatttctaggaagaaggactgattgaatattttttaaatgcccactttggggagtggcaccagggaaatagtggagtgggaagctctgaattcctgtgtttcatcagaaatataataaacatatcagaaacattgagaactctgtcttaagtttgtaaaacagtcaaagtcttagagcaataattgaatgctgagtcaataaaagtcaggtaaaaattcccctgtaatgcaaggaaatcttagccaaaacaaagtaagcctagaataatcaaaatagcaaatcctggggaaagagaatacctcattgccagagttagtccattaaaatttagaaatgtccaattttcagccaaaaatcataaagccatacaaagaaatcagaaagtattggacactcaaaggaaaaaataattcacagaagt

SEQ ID NO: 100832 - DNA, 852 bp, Homo sapiens
aacctaggtcaggacaggcacacctgctttcccgcccaaacttcgcattttccaagaccaccctggctctccatgcccccattctgggcctataaaaacccaagacccttgcaggcagatacacaagtggctggacgtcctaatgaacaacacatcaggggaagaagacacaagcgctggtcatccataggagcaccccagcagaaggacacgctgacaggcacccggaagccagtaggccgtggaccagcgggaggaggcggaggttggcctgggcagtcaggggagagccggggctgccgagcaccccaactccaggggaaaaccatctcccttctggctgccccatgggcggagagctacttccactcaataaaactttgcactcattctccaagcctatgggtgatccgattcttcaggtacaacaaggcaagaacccagatacagaaagccctctgttcttgccacaacgtagagggcctaattgagctggttaacacgagccgcctatagatggcagactaagagagtatcctgtaacatgcccactggggcttcaggagctgtaaacattcacccctagaccctgccctggggtaggagtcccacagcctgcccgtctgtatgctcccctggaggtctgagcagcggggcactgaagaagcccgctatgcccccatcgcgagccccgcgagggggaggagggagcctttgccttttcaactggagacatcgaccgggatcctggaagggtgtggttaagagaaaaaaaattggccataaggaatcagacaataggatgtctgaagtgaggatatggcactaattctgaaatttaagtatctggac

SEQ ID NO: 100833 - DNA, 5168 bp, Homo sapiens
  misc_feature (4816)..(4816): n is a, c, g, or t
  misc_feature (4888)..(4888): n is a, c, g, or t
  misc_feature (4910)..(4911): n is a, c, g, or t
  misc_feature (4941)..(4941): n is a, c, g, or t
  misc_feature (4946)..(4946): n is a, c, g, or t
  misc_feature (4986)..(4986): n is a, c, g, or t
  misc_feature (5022)..(5022): n is a, c, g, or t
  misc_feature (5054)..(5054): n is a, c, g, or t
  misc_feature (5062)..(5062): n is a, c, g, or t
  misc_feature (5101)..(5101): n is a, c, g, or t
  misc_feature (5156)..(5156): n is a, c, g, or t
cttgtgagattcatttctagagttgatgctatttctttttgtcaggggacctttactcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtactggaagacactgggatgcccatggacgatgatcagtatgccctgctgaccactaaaataggcttcgagaaggaagggatgagctatcttgattttgcagcaggatttgaagatcctccaatgagagggccggaaaccactccgccgcagcctccaactccttcaaaaagttacgtgaacagccactttatcaccgcagaagaatgcctgaagcttttccctaggaggctgaaggagtcattccgggacccctactctgccttctttaaaacagatgctgacagggatggcataatcaacatgcatgaccttcacagactgctcctgcatctactgcttaatctcaaagacgacgagtttgagcgcttccttggccttcttggcttgagacttagtgtcactttaaattttcgggaatttcaaaatttgtgtgagaagagaccatggagaacagatgaagcgcctcaaagactcattagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggttgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacaggtaagaaacgccagtcagtcctcaccctgcacaccgttggctgagcgtcagcctggtccctggccagaatgtacagagtttaagactgttctctatttttaaaatgcttgcagttttgttattttgtttttcaatcttcctgaagattcacaggaatcttctgtttatgtaacaactataaattacaccattttcatcagggtacaaatactgtcactgttgcctttaaaatcaaattcaactccgcttcggctcccacactccttctcccttccctggagcatcccggaggtaatgtggtctgggtctgtcatgggcagcaactatctggggccagtgttgcgcaggcagtaaaaagaatgtaccaagacagttgtaggtaaaaaaggcagatgtattagaaaaagtatgaaaatatgttgcaagagtgcaaggggcaagtcagcaagagaaaagctgactgcaaagagacaaaggtttgctggagattttataggatggtgcttgtgctgggtgctgaagaaggctttgtgcagtactggaaacaccaaggttgcagtgagctaccttgcatttttctatgagccgggggtctggtgatagctgggcgcaggaaggttgttatttgtgcaggaggactacgtgttctggaccatgaacaaaggcagacttagcggcttacctgctttttcattttgctttcctctgttcccaccagcctgattcctttcccctaattaggactccacatggtccaaagaaggtgggcagtcggtccccacgcctggagggtcacagaccctggcaggaggctggcgctcctcccgccaccccaacctgccttctccttgctactacctggtgctgctgctggcagtgtgggatgctccgggctgctgctctaagcatgctgggtacatgccacccctggtgggcctctccactgtgcacaggctggacacaggccctgcctctctaagatcctcctccctatcacagaatccccagaaggaggttcttcccagcctcctcccctaaggactggactgagctcttctgtggctcaaaggctccgacaacctgctcccctgggccgctatggcccttcatggccttccaaggccaagagcacctcccagtggggtggcgtcctcagagtctgccttgccatggcagctgtgggagggaagagagcacctgcccagcctgcctcccatccatagtcacactgaacaccagcaccaggggagcagtgccccaggttgctttgttcctcgctgtgccctaaatgccaaagcagtgcagggcgctgagtgggtgctcagtacatgctgctgaatggacagcgtccatactccccagcccttcaccgtcctcggcagccccgtggctgatcagccaagtaacacagagcaccactgatccagttacagaagtagatttcccttcactcagaaaatgcacagctacaagccctctctagttctcaaatgcatcaatgtcccattcccagagaataattcagactaaaacataaaatccccaaatacttaacaaagcaactctgcctccctccttcctcctggttctgctcagtctcagcccagggagttccctgcagacactgcgtggaaatgtcactctttcgcctccaaaactgggccattacaacctcttgtctcattttgtcagagttgcagggtaaggccttggaagtattcatagggaagcgtgatcatcgcagtcacccctggctctactcacagctctgaactcactgccccaagaatgcatgccgtaaagacattaagaatgtgactatcaggtttaacattcctaaaatatcacctttctcaagcattttggtgtgatcatttttgctaagcaaaattaaatgctgtttccaaatgatcctgccccattgcacgtcaaagccgagcaaactctgtatttgcaaatactcctcttagcataaatgaaaataagcctttgaaattaatacagttgcatttattattctatggggccaagtaatcaaggttttactaataaagatttttttaatttcacctaaatgagtaaaattttactctaattatagatagaaattaatgacatgctgacatatctggcattcatcacagagaattcaattttaattgtccactaagaaaacttcaccatcctcagcacatcaagccccttccccaaccaaattaaacacttatttttaaacgcggctttctaaaaataagctgacgtgtctcttacatgcagccaacaaacatatgaaaaaaagctcaacatcactgagcattagagaaatgcaaattaaaaccacagtgagataccatctcacgccagtcagaatggctactatttaaaagtcaaaaaacaacagatgctggtgaggttacagagaaaaaggaatgcttctacactgttggtagaagttgggagtgtcagttagtttagccattgtggatgacactgtggtgatttctcaaagacctagaggcagtaataccatatgaccaagccatcccattactgggtatatgccccaaggaatataaatcattctattataaagatacacacacgtatgtacattgcagcgcttttcacaatagcaaagacaaggaaaaaaactaaatgcccatcagtgatnggctggttaaagaaaatgtggtacatctacaccgtggaatactatgcagccataaaaaggaatgagaggccnggcacagcggttcacgcctgtnntcccagcattttgggaggctgaggtgggtngatcncgaggtcagggtttcaagaccagcctggccaatatggtgnaaccccgtctctactactaaaaatgcaaaaaaattngctgggcacggtggcacgcatctgtagtcccngctgctcnggaggctgaagcaggagaatcacgtaaacccaggaggcngaggttgcagtgagccgagatcacaccactgcattccagcctgggcaaaagagcnagactctgtctc

SEQ ID NO: 100834 - DNA, 2095 bp, Homo sapiens
aaagactagcttgtgagcaggctcatcagtatcttgttaccaaagcaaaaaacagatggtcagacttgtctaagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggttgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttggggg

SEQ ID NO: 100835 - DNA, 1320 bp, Homo sapiens
tcctcactttgcgtggaaatatacaatctctaaagtcattcagttatatgttaaataacttgaagatgttttttgttccaagagagaagtgaagaatgtagttttcaaccaaagggatgacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttgggggtttcatgaattttcaaaaaaaacaaaactcaagcccaa

SEQ ID NO: 100836 - DNA, 384 bp, Homo sapiens
gtcatacagtgccctggaggcagtgcctgctcagaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttggggg

SEQ ID NO: 100837 - DNA, 3071 bp, Homo sapiens
ttagatgagaaagacatctccctgtacagatgctaagacacctttcctcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtactggaagacactgggatgcccatggacgatgatcagtatgccctgctgaccactaaaataggcttcgagaaggaagggatgagctatcttgattttgcagcaggatttgaagatcctccaatgagagggccggaaaccactccgccgcagcctccaactccttcaaaaagttacgtgaacagccactttatcaccgcagaagaatgcctgaagcttttccctaggaggctgaaggagtcattccgggacccctactctgccttctttaaaacagatgctgacagggatggcataatcaacatgcatgaccttcacagactgctcctgcatctactgcttaatctcaaagacgacgagtttgagcgcttccttggccttcttggcttgagacttagtgtcactttaaattttcgggaatttcaaaatttgtgtgagaagagaccatggagaacagatgaagcgcctcaaagactcattagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggttgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttggggg

SEQ ID NO: 100838 - DNA, 1947 bp, Homo sapiens
tcctcactttgcgtggaaatatacaatctctaaagtcattcagttatatgttaaataacttgaagatgttttttgttccaagagagaagtgaagaatgtagttttcaaccaaagggatgacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtgagcacagctctgcgcccagtgcctctgcagggagcagctgccaaatgccagcggccagaaacttcccacggggagccctctacctgctgccgaaggcccggtgtgacctggctgcttcagatctcacttccctgggacccccaagttatccagtcctgggtccactcgcctcaccttcagaccccgggttctccttcccaaaggttgctggagccctgcgtggatgccccatacctgcatcgccagctcctcagggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttgggggaaaaaaaaaaaaaaaaaaaaaaaaaaaaaaaaaaaaaaaaaaaaagagagagaacaacgaaaaaaaaaaaaacaacaaaaaaagaaaaaaaaaaaaaagagacacagaacagtgggaacaaacggcggcccccacaagcactgttaatacaacgagacacggcgcgacaagacaaccaaaacacgacaagagaaacaggaggagacaacacaccagccgccacgcagagcacagacatcatcgtgggagtagacagaagacacagaatacaaatctgcgcggggagggaagccacacaaaaagggagcagcaaccaaccctaatgccatacacacgacaaactatacaacaccgccacacgcgagaccaccaacaatagaaccgcacacaagaaggagcccaacagg

SEQ ID NO: 100839 - DNA, 960 bp, Homo sapiens
ttagatgagaaagacatctccctgtacagatgctaagacacctttcctcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtaggagaatgggtttctctttgtttctatcctgcagaagttcagctgttttcttatactaacatactttaaaggacaatggcttatcccaggacgcagcagatccatttctaggcatctttcaacaatttaaaaggatttttttttttggccaaaaaattgtcattggcacatttcttagagaatactttcaatatggatgtggccagcttttgatatttaagcttttacatatcagaagcatttattgatgcggtttggctatctgctgcatacctggcactgtgcatcattgggcagcctgcgggtgagagtacaaagccactcggcccctgcctgccagtggagagtttccaatcacagagctatggtttgttcctctagaatgaaaa

SEQ ID NO: 100840 - DNA, 681 bp, Homo sapiens
tagtgaaccgaggatgggaaaccttcttactgtcatgggttacatggaaatgggtgcagtctggaggaagcaccctgcgtgtgtcagttgacactgggtctaaatgcctgcttgtgattttagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtaggagaatgggtttctctttgtttctatcctgcagaagttcagctgttttcttatactaacatactttaaaggacaatggcttatcccaggacgcagcagatccatttctaggcatctttcaacaatttaaaaggatttttttttttggccaaaaaattgtcattggcacatttcttagagaatactttcaatatggatgtggccagcttttgatatttaagcttttacatatcagaagcatttattgatgcggtttggctatctgctgcatacctggcactgtgcatcattgggcagcctgcgggtgagagtacaaagccactcggcccctgcctgccagtggagagtttccaatcacagagctatggtttgttcctctagaatga

SEQ ID NO: 100841 - DNA, 1540 bp, Homo sapiens
tcctcactttgcgtggaaatatacaatctctaaagtcattcagttatatgttaaataacttgaagatgttttttgttccaagagagaagtgaagaatgtagttttcaaccaaagggatgacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtgagcacagctctgcgcccagtgcctctgcagggagcagctgccaaatgccagcggccagaaacttcccacggggagccctctacctgctgccgaaggcccggtgtgacctggctgcttcagatctcacttccctgggacccccaagttatccagtcctgggtccactcgcctcaccttcagaccccgggttctccttcccaaaggttgctggagccctgcgtggatgccccatacctgcatcgccagctcctcagggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttggggg

SEQ ID NO: 100842 - DNA, 363 bp, Homo sapiens
ctggtggagagaagggccccagtggtgacgcactgggcctgataatcagaaaccttggtggcatttgctgagcattttccatgtgtccctctcctcgctgggactctaggactgaaacccaggccacatcctcacagatgtcctggcatctccaaggcaaccctgaaaggaaagtatgttgatgaattaagcaactgtttgcttaattctccatgccattcttgaatttaagccccactgctgatcattgggagcaggagttagcatgcccattgacagacaagcaaactgaggcaaagaggttagatagccaggcatggtggcatatgcctgtaatctcagctactcaggaggccggagtag

SEQ ID NO: 100843 - DNA, 429 bp, Homo sapiens
tttattttgtgagtagaatgtttctctgaatgctggaaacaataaagccaaccacttgcctgtaattagcctggaccccataagtcacccagacataataccaagctctaaaattgccttcagagtaaggggccagcaccctggagttacaggcacttgcttttttggcaccagatttattgacattaatgatcccaatcccatatggagttccctggactgtttagataatgaatttgccttatgacagcagtgctccttctaatgaggaatgagtattttctataagtttttattttaatgtggtggctcttgtgatattgatcactggatcatgtgctgttcaagctcagctttaattttctcgataacatggttcaccaatccattgggatgctggtttaaacaaggatggaattctacagaact

SEQ ID NO: 100844 - DNA, 1236 bp, Homo sapiens
agcacacggagctgaaggagaagtgcgcagcatccaaccaggggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaaaaaaaaaaaaaaaaaaaaaaaaaaaaaaaaaaaaaaaaaaaaaaaaaaaacacaaacaatatggtgtgcccacccaacaaaacctcccccatcagagtacacccccagttcaccgacacccccattttttttaaaacaaacgtggccccaccatatgggggcgcgccttaattatacagcaagccggagcggcgggcgccaaggtttataaagaggtgcggaaacggaggacaaaaccggcgcccacagagcgggacacacattgcgcgcaacgagggtgcgaacaataaacatacatagtgggggagacaaaacaaaagtggggcgaacaaacaaccacaaagagagagctgttattaagaccctcacaaggagcggaatataaagaagcattacagcggggcatacacg

SEQ ID NO: 100845 - DNA, 589 bp, Homo sapiens
gggatacctggagtggcataccagagctgcggtattcatggatgatgggctgtggctaggacttcaggaagtggacgggcacaggtgggaagggtcctcaggtccagcctctaccgggaggtgtttgcagcccctcaaagcgccggtgcatggtgagcaatggtggagattctccagcacgtcatcgattacatcagggaccttcagttggatctgaactcggaatccgaagttggaacccccggtggccgagggctgccggtccgggctcctggggtttatcgtgtgagcacaccatatatttacagtaggaatagacgtagacacacgagcatatttcacccccacgagcccacgacgagccccaccaagtgccacgcaacgagcctcaccaggcgccacacgaagatcttggggctggcacgggtgtcgaggcaggaaggattgtttctggtgactgcagccgctgccgtcgcgacacagggcttggtggtggtaaagaatcctcaagatcaaacccacgcagtgctgagagcttggcctgattctagggctggggctggagaaactgctagagatgatgcggata

SEQ ID NO: 100846 - DNA, 238 bp, Homo sapiens
caagccccttcagtcagagctgggccgatctcagacccaaatgctaccaccaccaagccctgtgtcgcgacggcagcggctgcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacca

SEQ ID NO: 100847 - DNA, 1344 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacca

SEQ ID NO: 100848 - DNA, 1287 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacca

SEQ ID NO: 100849 - DNA, 1756 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaaaaaaaaaaaaaaaaaaaaaaaaaaaaaaaaaaaaaaaaaaaaaaaaaaaacacaaacaatatggtgtgcccacccaacaaaacctcccccatcagagtacacccccagttcaccgacacccccattttttttaaaacaaacgtggccccaccatatgggggcgcgccttaattatacagcaagccggagcggcgggcgccaaggtttataaagaggtgcggaaacggaggacaaaaccggcgcccacagagcgggacacacattgcgcgcaacgagggtgcgaacaataaacatacatagtgggggagacaaaacaaaagtggggcgaacaaacaaccacaaagagagagctgttattaagaccctcacaaggagcggaatataaagaagcattacagcggggcatacacg

SEQ ID NO: 100850 - DNA, 569 bp, Homo sapiens
ccactaaagcagctgagagcgcagaactgaggacaagagcgtgggcgaggacgtgtgaccgacgcaaacaccctgtgagcgaccaaggactgggtacacgtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacca

SEQ ID NO: 100851 - DNA, 652 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggcctggggtcgtccaggccggctccctgggtgacggagggagttgtgggcccggaggggtggattgactgcgcgggcgtcaccggcgcgtgcatacaggcgggcgaagcgacgttccagcgaggaccctggcagccgcgatgcagacgcgaacggcgggcaaggtacatcagcggcgatgacagaaccaaccacaaagagctgtcacccagaacccagccgacgctcggggagggaggaacgttgcagcatggaaccagaagcagaatccaggatgatgggatcaaagg

SEQ ID NO: 100852 - DNA, 226 bp, Homo sapiens
gcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccacccgcttgttggctggtcactaagtgtcctggtggctggggccggagccagtgctcgtgaagggatcgc

SEQ ID NO: 100853 - DNA, 824 bp, Homo sapiens
agcacacggagctgaaggagaagtgcgcagcatccaaccaggggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacca

SEQ ID NO: 100854 - DNA, 647 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctg

SEQ ID NO: 100855 - DNA, 302 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgactccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctg

SEQ ID NO: 100856 - DNA, 1098 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaactggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacca

SEQ ID NO: 100857 - DNA, 1167 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagccaccagggctacagcactgaggctgagttcgaggagcccagggtgattgacctgtgggacctggcgcagtccgccaacctcacggacaaggagctggaggcgttccgggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacca

SEQ ID NO: 100858 - DNA, 1302 bp, Homo sapiens
gcgccgcggagggtcaggtcgtttctgcgcgggctcccggcgctgctactgctgctgctcttcctcgggccctggccattgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacca

SEQ ID NO: 100859 - DNA, 168 bp, Homo sapiens
caaaaaagaaaaaaagaaacagaaaccaggcaaaccatacatctaaaggatctattattctccttggacatctttttagaattcgaagaattaggttttgtggctcagaaagaccatgtactctagggagtatgtattactccaaatacacaggcaatttccaggaca

SEQ ID NO: 100860 - DNA, 252 bp, Homo sapiens
ttcttcttattcaaacactcgcagcaggggcaaagaaagcgacttcggccgcatcttaagttttaccataactttctggcattttcttttcttccagttttcccagactacttaggggcagtgaagaattataacatacatgaattattagtactcccctcgagttaaagggggaggaaagcgcctcattttctatgcccccaagggacggaccgagcgggcagcctctaaacaatgtatttatcactttgc

SEQ ID NO: 100861 - DNA, 378 bp, Homo sapiens
ctgtggtagctccttcttggctgattttaaaagatggcttttcccagagcttcttagaacttgctcttagcaaaggatctgtgtttcccatcgaaaaaaaagtaaaccatttaataaatttttaaaataaaatttggaatggcttccatcttgtttcttgtcatcttctcctctcaaaaagcctccttttcccttttttcatcctagttttgatgtctgagcagttggcctttctagatacccttatttagaatttttctcttcttcattctacggggagtgtcgccagtgggtaagtgcagtgggcactgcactgggtgagactcgcccttgccccctccctgctcactgctcgggggacttcgaatgaagaagaga

SEQ ID NO: 100862 - DNA, 653 bp, Homo sapiens
gtgggatccaaccatgtatgaatagatctccctgagtgagctgagatctgatgtaagagccccttgtcccgatgtcatggccagtccctgtgactggctgcctaatagtacttactggcttctcttgcagttatgcttgagactttgtggcccttcagaatctgtacctctgtcacttcaggactaacctctacagccaggtcatttccaccagggcttccccgtgtggcccagtgcgctttccccccttgccacccagccacccctgtgtgtgtgccagggagcacagatggcagtctgagctcaccacatggttttcctcttctaatctgtaaatgtggtggagtatcataacattctctcacgttaagatatccttgcattcctggaagaagacagtcacaatggatttgttattatactgccggatttggttctctggtattttggcatccaggtgtataggtgaaatggtttaaggttttccttttccgtactgcccccaccctttgttttgtatcaaggttataccagcttcatataaataagttggaaagtgttttccctttattttcattacgagagtttgtataagattggaattttgcatttctacaatttttggtaaagcttgctgtaaaaccaaccatgcc

SEQ ID NO: 100863 - DNA, 711 bp, Homo sapiens
taagacggggtctcagtatgttgcccaggctggtcttcaattcctgggctcaagtgatcctcctgccttgcctcggaaagtgctcagattatagtcatgagtcactgcacctggcctggcattttcttggaatgttcaacacacacctgtagtatgatccagccattccaccgctaggaatctgcccaagagaagtgaaagcagatgttctcataaagacttgtacatgtaacaacatgcacagatttcaaagtatcacatctatctgattaactccactgttacactggttgccactgctacatatatttttgatttctgcaaaagggcctactgcactgactggatggaaagtgtggcaggtgaggcaggaggtagttttctggacattacttaaaactttcagggcaacagttttacacctgctttcatagcaagtcatatttagtaagcatttactgtgtcagtcatggttctaaggggcttgcatggattctaatggaattgtcatagcatgagctgtggggactattactgtccccactttcagacaaaaaaaatgtaggcagagagaagttaggaaacctactggaggccacctggtgagaagagatagagtctgggttagaacctggggcttccaactttcctgccatgaagcgtcactctgcttccagccagggctgtcagacatcattggtcctgcttaag

SEQ ID NO: 100864 - DNA, 143 bp, Homo sapiens
tgaagtggtgtgctggggtcaggcgctctcacgggagtctgcaggcctggggccacgtgcaatgcttgtggctgtttgtggtttgcccccgatgccccaggccctgtgacgcacctcccccgcacatcacgttcacatgagct

SEQ ID NO: 100865 - DNA, 849 bp, Homo sapiens
tttttagtagaggcggtgtttcaccatattggccaggctggtctcaaactcctcaggtgactctcttgccttggcctcccaaaatgctgggattacaggcgtgagccaccgcgcccagcctgttccttcttcttaaaacaatctttgacttaactccaattcctgcagatattagcttaaatgtcactttctccactgataaagcgatagtctcagaaatgtttcctgtttatatttctctaaacatattgtacttttccttcatagtactttattacactgtacaatttatttttagatttcattagtatctgtccttcctgttagagtgtaacctctgcagtgtcatgtagagcatgtctctcttatttgccattgtgtcccagtgccaggcacataatggttagcactcagtaaatttagactaagttaattaatgaacagaattaagtctggatgttctgccctgtatctctggtttttgttttataccagcatttcccaaactgtatttcaaaagttttctatcaatgattagtggataatttctgaaaaaaatgattccattgtcattggttcggaatggctgtatcctcctttaagaactacagtttacattaccatgctctcagaagtccttaaaaaaaaaaaatctaagtttcaaacccagccttctgtacacttaaattatcaaacttctcattagactacctattaataatttgaaagtagtacttcagtgaaacagcttggaatatcattgtaatttacacttgtataatctcagatatttagtcaagtcattagatatctgttgaatgaaacacagaactcatttcctaatttatt

SEQ ID NO: 100866 - DNA, 507 bp, Homo sapiens
gaattccatgtctattgtttgtaagtattttaaaattttctatgtaaagctcattttattcaattctaaggaattataatttttaaccatattttactaatttttcagtttcagataactatgagtaaatggttcacagcatttgtaagaggtgcaagaaagaatttaagattttaatgtattacggatttttcaagggcagtgtttttttaattgaaaaagtaataaaattctcaaaacttcagtttgtgaaatgacataaactgatgcttaaatgccatctaattcagtctctaacttcctggataaattcctcaaaattatttcaaacatgtgatgattcatattttacctaaacacattcagagatagaaatagggggcttaaattgggtcattcattccatattcagaaagctctatttatcttaaagttctattgtattgagtcaaaatttatgtccctatgattcgtattcattaatgttagttctctcctctggaatta

SEQ ID NO: 100867 - DNA, 561 bp, Homo sapiens
  misc_feature (324)..(324): n is a, c, g, or t
  misc_feature (332)..(332): n is a, c, g, or t
  misc_feature (337)..(337): n is a, c, g, or t
  misc_feature (339)..(340): n is a, c, g, or t
  misc_feature (343)..(343): n is a, c, g, or t
  misc_feature (356)..(356): n is a, c, g, or t
  misc_feature (359)..(360): n is a, c, g, or t
  misc_feature (365)..(365): n is a, c, g, or t
  misc_feature (367)..(369): n is a, c, g, or t
  misc_feature (372)..(372): n is a, c, g, or t
gcatttcggagtgcatggctactgatgttgagcatattttcatgtgctttgttgaagatgtgtatactttccttggagaaatgtctcttcaactgttgaccattttaaaatcagatagtttgtctttttgttgttgacttgtaagaattcttttttcttttcttttcttttttttttttagacatcgtctcgctctgtcgcccaggctggagcgcagtggcgctatcttggctcactgcagcctccacctcccgggttgaagcgattctcctgcctcagcctcctgagcagctgggattacaggtgcacaccaccacacccaantagttttngtatntnnagnagagatggggttncannatgtngnnnagnctggtctcaaactcctgacttcaaatgatccacctgcctcggcctcccaaagtgttggtattacaggcatgagccactgcacccgccctatggattcttttaatctatccatcaccatatcccattgactctatgtcaaaaacgtggaccaaatctgtgtgtttctttcctgtccactacacctgctgc

SEQ ID NO: 100868 - DNA, 383 bp, Homo sapiens
cagtcagacctggacctgccttccttccctgtgagatggagggaaagctggggatttccccaaggcggcgaacgccctagatttagatatatcccatcatgccggaagtgtcagcaccccctagattattggcagctgcatgacctaccagctcatgattaaactcttgcctggtcctacagaagagatctctgctgggttggcattcctccgcttaaattatcaaagtagatacagtccagttatgtattttggcatattatacttttgcagttaagtaattgggtgtagcatttagattaatcacttaatcatttttaggactccagtcctatcaaggggcaaaaagggcacatagatcacactgaaattcctctgtgaaa

SEQ ID NO: 100869 - DNA, 414 bp, Homo sapiens
ctaacacaggcagcttatggcatgcaaaaggaggctgcaaagtaaccactgttggtgtgtccagggttagaaaaatttccacagggatttctgtgaaatccaattaaggcagccctttctttttaatagatgattatggagaaaagagactgacgaaacaaaatcagcaaggggaagttaaaaaatttcctgaattgttcagtttcttgtggaaactctagttcctgaatctgagtcttttgctgagatagtgtacagaaagtttgttttgctgctcttcccacttccctcagaatacattatttctgagggaagaactcaccacttttgtctctagccagctttcagttaggcacctggccctaaacttagtcttaaagatgcagtcaaggcctggcaaagttcctttgtctg

SEQ ID NO: 100870 - DNA, 425 bp, Homo sapiens
tcaaaccactgccaccatttactccacattcttttacagggtctactctaaaaaaaaactgtgtctactaaccataaaccaaacctactgaagagtccctctgcttgtgaaaaggacatcattctttttcaactttagtcaaaattttcccacattttggccttttttatcatctgaatctgatctttacatttctacatatgagtataatcttccaaacatttgcttaaaaggcacaagtaattttgctttgttaattaaaaaaaatttttgtttggctgggcatagtggctcatgcctgtaatcctaacacattgggaggctgaggcaggaggatcacttgaggccaggagtttgagaccagcctggccaacatggcaaaaccctgtctctaataaaaatacaaaagttagccgggtatgttc

SEQ ID NO: 100871 - DNA, 438 bp, Homo sapiens
ttttcaggtcccgaataaagcaagtcttcgagaacactaaaatttctaccgcatgctgccttaagcatcacccttactgagaaatggtgatatctcttctatatcaacaggagtggtggtgaactgtaatttctaaaaggcaaaattgcattgtaaaattgctaaatgttgcaaataaggattttagagaagctatttggtcacagtagaatggagatttctgttaacgttcaatggaaggttcacattagaggtcatctcagagagatcaaggtaatattcttttagaaacttgctatgaccctctactgtaattagtgagtccgagatacctgagggaaatctaaatttgtgatagttctggtaggcctttgtagtcagaagtggggagaaattgaaagtttggatgagacttatgtctactgttattgacatatt

SEQ ID NO: 100872 - DNA, 397 bp, Homo sapiens
gccaggcacagaacaactaccagggaactgtgaactgaataactactaaaattcacacaagactgtaagacattgagtgttcaaacaggctacagtggagaaacccacagacattcaacagagaccccagaaaatccacatttagggctagggctaatccagccctacagtaaaggctggcccctgttctaacagagactgaaacaaacctcaaaggatcaagatggtctgcaagtgaattaacagcctgccaggacgacattcaacactctttaaagagaacaacaaaatccaaacactcacgggccagcattcctcatccccatagccagcccaattcactaggcacagcaagaagcaagaaaatgtggtctgtattcgggaggaaaaaatccat

SEQ ID NO: 100873 - DNA, 221 bp, Homo sapiens
gtattttccatctttttttctcagtgctacactgaacagtttcatctgaccttaattccaattcagtaattttctctttagctgtgtttaatctgctttaaaactcacccatcaatttcttaattttagctattgcattttagttctagaattccttttttaaaaatttgttatgtatttaatagttttcagttccctgctgaagttttcaagctggtgtt

SEQ ID NO: 100874 - DNA, 540 bp, Homo sapiens
taaattcttgaaaagttttttgaagactttgagcctgaggcctgttcttattgtttgtttgtttgtttgtttgtttgtttttatgacagagtttcgctcttgttgcccaggctagagtgcaatggcatgatctcggctcattgcagcatttgcctcctgtgttcaagcgattctcctgcctcagcctcccgagtagctgggattacaggtgcccgccaccatgcccagctaatttttgtattttagtagagatgggtttttgccatgttggccaggctggtctcgaactcctgacctcaggtgatccacctgccttggcctcccaaagtgtggggattacaggcgtgagccaccatgctcggcctgttcttattgttaaaaagagagatttgtgtgaaagctgctgacgtctttttggcaccaagtcaagactgagttagttcttgtcagaatctgattgtttgtgaaattgatggctttttttttttttcctgagttgggggtctcgctctgtgccccaggctggagtacgaccactat

SEQ ID NO: 100875 - DNA, 485 bp, Homo sapiens
taaacaaaaaaaaatatgttttaaatttgcctagtataagtgctactttctacagaaggccttcccaggtttgtcttaaccagaattattctgccttcccccatgctctgatagcccttggtttgcacctatataaaagcacctaaataccagtgcaatggaggcagtagagtatgctgggcaacccacagcctctggagttgggagagcctggctttgtatcctgcctcttttagcttcaaagacaagttatgagaacttaaccactctggacctcagttttctcatcataagatggcagtagtaatatctatctcataggggctgttgtaaaaattaagtaatgttatccaaggtacttagcaaagtacctaatagagtagttctgtgtctggcatatagtaaggattcaatttatcttggagattatttagagaattttggacatttaaccattcacttaataaataaatatttattaacaa

SEQ ID NO: 100876 - DNA, 731 bp, Homo sapiens
ttcaaggtataaatttatctttttctatataccataccagctaaatttaagtataaatataagagcagtttcttccccagttctttctggtcatggcagacgtaaaaaatggtactcattgaacagcgtgccactctaccctatcccacaggctaagcagatcaatagctgggtaccccagaaacccaactgtgaactaatttgtggagactaatgcaaatattgtagataatagtcctaatacttgcaagacttgcagggattagatcggtcaaaagtgatttacaatatcacaaacataaatttttaagtaaacttttaactattttaggatttaagaaagcagtctcaactagtttaagagtgggagtgaaagtaaagacagtttacttcttacttaactgaataaattagtatgaagaccagtcgagtcattgcagacattttaggtaatggccttttttttcatctttatccttttcggttggttggttggggtttttttttttttttttttttgctttttattttgaaataattttagactcaaaagtcgcaaaaaaatagtacagagaaggcccatgtacccatcacccattgatggtaccttacataactacagagtattatcaaaaccaggaagttgatgaactacacaatactattaactagacttactgaagtttcaccagttttatattcacttatttttttctgtgtctttatgaatg

SEQ ID NO: 100877 - DNA, 672 bp, Homo sapiens
agggatctaggttgccggttccttgtgagaatctgagaatctaactaatgcctgatgatctgaggtgaaacagtttcatcctgaaaccatatccccacccagatccatggaaaaaaatgtcttccacaaaactggtccccagtatcaaaaaggctggggaccactgctctgaaagttttgtttaggtggaagagtggcatagggctatgagtatttatttgatttttgttttaagagacagggtcttctatattgtccaggctgatctcaaactcttgagctcaagtgttccccctgtcttggcctcccaaagtgcattttgatggtctttgaaaaatatttggacaatagagccttgacagaaaatttaaataattaaataaaaaatgttttaaaattgtccttttatgggctcattttcttagattgtaactcttatgcagtcattttctctttctttttttccttctttctctttttcttttttttttttttttttttgtggcagtctcagtctgtcttccaggctggagtgtagtggcgtgatcagggctcactgcaggtcacaacctcctgggctcaggcgattcttccatctcagcctcccgagtagctgggactacaggcacatgcaaccatgccaagctaatttttgtagagacaatttcacca

SEQ ID NO: 100878 - DNA, 853 bp, Homo sapiens
ctggggcctcagccacaggcagctgtggcctggctgcccacctccttccttcccagccaggagcactgctgcagcactgagtggagagccccacagccagcagcccttcgggggtccatgggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccaggcatggtggatgctcgtggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccagcccacctgttcacctatggggccttagcttctgaccaatgtcccacctcctcatgctgccccaagacccctcctaccccaccatggctatgcctagcctgctgatgatggtcaa

SEQ ID NO: 100879 - DNA, 847 bp, Homo sapiens
atgccctggggaggtagcacaaagggaggaccatggtcttctaactgaggaacctgagcagatgccttgacccagaccagagacccaagccaaggaaagcccatgatcaccagaggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccaggcatggtggatgctcgtggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccagcccacctgttcacctatggggccttagcttctgaccaatgtcccacctcctcatgctgccccaagacccctcctaccccaccatggctatgcctagcctgctgatgatggtcaa

SEQ ID NO: 100880 - DNA, 847 bp, Homo sapiens
atgccctggggaggtagcacaaagggaggaccatggtcttctaactgaggaacctgagcagatgccttgacccagaccagagacccaagccaaggaaagcccatgatcaccagagtgggttgggaagtgcggatagaggggaagtagtttttatttttttctaacagagaggttgtgcaaggtgttctgagagttgggagcagagtgtgatgccaggagagggcagagctggcagatggaagccaaaggtgtgcgggtcaccccttctgggtggggacatctgatcgacctagtccatgtatgcctgcatgaagtgctgggtaatggggatatgaaggaagaatcagctgcacaattaggttgttgtcataggcccatggccctgggaggtacagggggctccctgtcccccagcctggacttccagctcttccgaggtgaccagagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccagcccacctgttcacctatggggccttagcttctgaccaatgtcccacctcctcatgctgccccaagacccctcctaccccaccatggctatgcctagcctgctgatgatggtcaa

SEQ ID NO: 100881 - DNA, 978 bp, Homo sapiens
cagcaaggaagggcttggcaggcagaggcttctccacgtgggaacctgagggagtctgtcctcagcccacctcctggggcatttcctagccaagccagggagctttcaggattggagacctggaaatctccaaggccatttccttttttatttttttctaacagagaggttgtgcaaagtgttctgagagctgggagcagagtgtgatgccaggagggggcacagctggcagatggaagccaaagggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccaggcatggtggatgctcgtggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccagcccacctgttcacctatggggccttagcttctgaccaatgtcccacctcctcatgctgccccaagacccctcctaccccaccatggctatgcctagcctgctgatgatggtcaa

SEQ ID NO: 100882 - DNA, 981 bp, Homo sapiens
atgccctggggaggtagcacaaagggaggaccatggtcttctaactgaggaacctgagcagatgccttgacccagaccagagacccaagccaaggaaagcccatgatcaccagagtgggttgggaagtgcggatagaggggaagtagtttttatttttttctaacagagaggttgtgcaaggtgttctgagagttgggagcagagtgtgatgccaggagagggcagagctggcagatggaagccaaagggtaatggggatatgaaggaagaatcagctgcacaattaggttgttgtcataggcccatggccctgggaggtacagggggctccctgtcccccagcctggacttccagctcttccgaggtgaccaggtcttctcagcctgcagaccacttccaggcatggtggatgctcgtggcccatcctgtgccagctggctgtgtcccttgcccctggcaccgggcaggtctgcactgctggcctgcctacaggacctggacctgaacctgtgcaccccacagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccagcccacctgttcacctatggggccttagcttctgaccaatgtcccacctcctcatgctgccccaagacccctcctaccccaccatggctatgcctagcctgctgatgatggtcaa

SEQ ID NO: 100883 - DNA, 703 bp, Homo sapiens
ctggggcctcagccacaggcagctgtggcctggctgcccacctccttccttcccagccaggagcactgctgcagcactgagtggagagccccacagccagcagcccttcgggggtccatgggtaatggggatatgaaggaagaatcagctgcacaattaggttgttgtcataggcccatggccctgggaggtacagggggctccctgtcccccagcctggacttccagctcttccgaggtgaccagccggcacccctgggcacagacctgcagggcctccaagaggacgccttgagcatgaagcacgagccaccagggctgcaggccagctccaccgatgacaagaaattcacagtcaagtacccacagaacaaggacaagctgggaaaacagccagaaagagctggcgagggggccccctgcccagccttctcctctcataacagctcttccccaccaccgctgcagaacagaaagagccccagccccttggctttctgcccctgtccccctgtcaactccatctccaaggagctcccatttctcctccacgccttctaccctggatacccacttctcctgcctccagcccacctgttcacctatggggccttagcttctgaccaatgtcccacctcctcatgctgccccaagacccctcctaccccaccatggctatgcctagcctgctgatgatggtcaa

SEQ ID NO: 100884 - DNA, 688 bp, Homo sapiens
  misc_feature (20)..(22): n is a, c, g, or t
ggccgcccggcggggggccnnngccccccccgccccccccgcgccgcccacccccccccgcgcctgctgggagcaaaggacagcctcagagactaatccttggagaccaaaaagctaatcagccaggcatggtggcctgcgcctgtagtcccaactactgaggaggatgaagtgacaagatccctggagcccaggagttcaagaccagcctaagcagcatagcaagactctgtctcttaatcaaaaaagaaaaaaaaaaaagcaagctgatgagatcatttaaaacccagtctgccttaatccaaactctactcttttacactacataatgtgacttcaaatactttttcatcaaaatgttttcatgtgaaatcaaggtgagataatcgaatgaaataattttttaattgtggcaaaatacatataaatattgccatcgtgacatttaatacattcacaatgttgtataactatcaccattatttggatccaaaacattttcatcaccccaacaggaaatcccaaactgatgaaacagtcactccccaccctcagtccctggcaaccactaatctctatattatatatttacctattctggacatttcatataaataagatcttatgatttgtatttgatccactatgtctggcttctctcacttaacatgtgttcaagattcatcta

SEQ ID NO: 100885 - DNA, 753 bp, Homo sapiens
agcgggttgtttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtccatggggagatcacagaagagagggacatcctgagccggcaacagggagac

SEQ ID NO: 100886 - DNA, 651 bp, Homo sapiens
agcgggttgtttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttctggggaggagtggccagtgcagcagcagccaggaccgcaccatagccgaactacaccgcagccgcctggaagtggctgaagttaacggcaggctggctgagctcggttgcacttgaaggaagaaaa

SEQ ID NO: 100887 - DNA, 92 bp, Homo sapiens
ggtgccaggactgtcaccttcctccaccagctgaaccctggagtaaactgccaaatgctgacagtgggaagaagcggaatcaggcctacttg

SEQ ID NO: 100888 - DNA, 322 bp, Homo sapiens
catgagaggggatgatagcagctggtggccctgtgccagatcctggccacagctggcctcagtcatcttcacgagaggagcccttgaggcacgtcttgctctcatccttgggtggttagtggtggcttgaggctgggtggtcagagtagctgtccaaggtcagcactggccatggaggagcccggccacccgccaagctgcacggcgcctccgcctcgggtgccacacagccccccacggagagactcctcatccgccatcctccctgccgctgcctttattttgcccgatcatattttaataaatactcgctttgaacttg

SEQ ID NO: 100889 - DNA, 665 bp, Homo sapiens
ggtcgtctagaggatcccgaggctgcagtgagccgagatcgtgcactgcactccagcctggataacagagcgagatgctgtcttaaaaaaaaaaaaactttattatcaagctctcacagcactactagaagtgatcactaagtcaaaatatactgagtgcctatttggtgccagtaactgctccaaggtgctgggattacaggcgtgagccaccgtgcctggcacattttagttcttaacttacctaacttctctttagttttctgcctatagagcttctttctcctcacccgtgttcctccttgtctcagataagcaggactgctgtgattaggacggatcagacgaagaggggcgtcgggtatggggttatggcagggggttttatatggataatggtggtgatgaaattgatggcccctaagatagaggagacacctgctaggtgtaaggagaagatggttaggtctacggaggctccaggttgggagtagttccctgctaagggagggtagactgttcaaccggttcctgctccggcctccactatagcagatgcgagcaggattaggagagagggaggtaagagtcaaaagcttatgtggtatatgcggggaaacgccatatcgggggcaccgattataggggaactagtcagtgcaaag

SEQ ID NO: 100890 - DNA, 2128 bp, Homo sapiens
agcgggctcggggctcggctggcctcggctcgcctcgagctgcgctcggcaggctgcggtaaatccgggcttgcggccgctggcgtagtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggcgcagctccgcaccgcgctggcctctggaggcgtcctggacgctagcggcgattaccgcgtctacaggggcctgctgaagaccaccatggaccccaacgatgtgatcctggccacgcacgccagcgtggacaacctgctgcacctgtcgggtctgctggagcgctgggagggcccgctgtccgtgtcggtgttcgcggccaccaaggaggaggcgcagctggccacggtgctggcctacgcgctgagcagccactgccccgacatgcgcgccagggtcgccatgcacctcgtgtgcccctcgcgttacgaggcagccgtgcccgacccccgggagccgggggagtttgccctgctgcggtcctgccaggaggtctttgacaagctagccagggtggcccagcccgggattaattatgcgctgggcaccaatgtctcctaccccaataacctgctgaggaatctggctcgtgagggggccaactatgccctggtgatcgatgtggacatggtgcccagcgaggggctgtggagaggcctgcgggaaatgctggatcagagcaaccagtggggaggcaccgcgctggtggtgcctgccttcgaaatccgaagagcccgccgcatgcccatgaacaaaaacgagctggtgcagctctaccaggttggcgaggtgcggcccttctattatgggttgtgcaccccctgccaggcacccaccaactattcccgctgggtcaacctgccggaagagagcttgctgcggcccgcctacgtggtaccttggcaggacccctgggagccattctacgtggcaggaggcaaggtgcccaccttcgacgagcgctttcggcagtacggcttcaaccgaatcagccaggcctgcgagctgcatgtggcggggtttgattttgaggtcctgaacgaaggtttcttggttcataagggcttcaaagaagcgttgaagttccatccccaaaaggaggctgaaaatcagcacaataagatcctatatcgccagttcaaacaggagttgaaggccaagtaccccaactctccccgacgctgctgagcccttccctcccctaatctgagaagtcagcctcttggctcctcaggccaccatttaggcctgactggggtaagaaatgtcgctccactttacagaggtagctgtggtgttgaaacactggacttggatatggggtgctgggatcgattcctagctttaccactaactagctgtgtggccttgagtaaatcccgttacctctctgagcctcggttaccctgtctgtaaaaagggaggtgagaatacctacctcacggaactgttgggaggctcagatgagatgctatatgtgaaaacattctgtaagcttcgtacaaatgtgaagtattaatattatcgcagtattattgttgttattattattgttattattaacaatcttgggtgggtagtaggagagcaaaaagtatgaatgggatggagctaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaataaatgcgtgttcacacccacaaaaaaaaacaacgccgagcaaaaattcacctgaggggccacgctacgcgacccgctacgacacgggcca

SEQ ID NO: 100891 - DNA, 1722 bp, Homo sapiens
agcgggctcggggctcggctggcctcggctcgcctcgagctgcgctcggcaggctgcggtaaatccgggcttgcggccgctggcgtagtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggcgcagctccgcaccgcgctggcctctggaggcgtcctggacgctagcggcgattaccgcgtctacaggggcctgctgaagaccaccatggaccccaacgatgtgatcctggccacgcacgccagcgtggacaacctgctgcacctgtcgggtctgctggagcgctgggagggcccgctgtccgtgtcggtgttcgcggccaccaaggaggaggcgcagctggccacggtgctggcctacgcgctgagcagccactgccccgacatgcgcgccagggtcgccatgcacctcgtgtgcccctcgcgttacgaggcagccgtgcccgacccccgggagccgggggagtttgccctgctgcggtcctgccaggaggtctttgacaagctagccagggtggcccagcccgggattaattatgcgctgggcaccaatgtctcctaccccaataacctgctgaggaatctggctcgtgagggggccaactatgccctggtgatcgatgtggacatggtgcccagcgaggggctgtggagaggcctgcgggaaatgctggatcagagcaaccagtggggaggcaccgcgctggtggtgcctgccttcgaaatccgaagagcccgccgcatgcccatgaacaaaaacgagctggtgcagctctaccaggttggcgaggtgcggcccttctattatgggttgtgcaccccctgccaggcacccaccaactattcccgctgggtcaacctgccggaagagagcttgctgcggcccgcctacgtggtaccttggcaggacccctgggagccattctacgtggcaggaggcaaggtgcccaccttcgacgagcgctttcggcagtacggcttcaaccgaatcagccaggcctgcgagctgcatgtggcggggtttgattttgaggtcctgaacgaaggtttcttggttcataagggcttcaaagaagcgttgaagttccatccccaaaaggaggctgaaaatcagcacaataagatcctatatcgccagttcaaacaggagttgaaggccaagtaccccaactctccccgacgctgctgagcccttccctcccctaattaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaataaatgcgtgttcacacccacaaaaaaaaacaacgccgagcaaaaattcacctgaggggccacgctacgcgacccgctacgacacgggcca

SEQ ID NO: 100892 - DNA, 949 bp, Homo sapiens
taggaaatatcattcgggctgatgtgttagaggggtttgattttgaggtcctgaacgaaggtttcttggttcataagggcttcaaagaagcgttgaagttccatccccaaaaggaggctgaaaatcagcacaataagatcctatatcgccagttcaaacaggagttgaaggccaagtaccccaactctccccgacgctgctgagcccttccctcccctaatctgagaagtcagcctcttggctcctcaggccaccatttaggcctgactggggtaagaaatgtcgctccactttacagaggtagctgtggtgttgaaacactggacttggatatggggtgctgggatcgattcctagctttaccactaactagctgtgtggccttgagtaaatcccgttacctctctgagcctcggttaccctgtctgtaaaaagggaggtgagaatacctacctcacggaactgttgggaggctcagatgagatgctatatgtgaaaacattctgtaagcttcgtacaaatgtgaagtattaatattatcgcagtattattgttgttattattattgttattattaacaatcttgggtgggtagtaggagagcaaaaagtatgaatgggatggagctaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaataaatgcgtgttcacacccacaaaaaaaaacaacgccgagcaaaaattcacctgaggggccacgctacgcgacccgctacgacacgggcca

SEQ ID NO: 100893 - DNA, 626 bp, Homo sapiens
ccacgcgtccgccacgcgtccgatcgattcctagctttaccactaactagctgtgtggccttgagtaaatcccgttacctctctgagcctcggttaccctgtctgtaaaaagggaggtgagaatacctacctcacggaactgttgggaggctcagatgagatgctatatgtgaaaacattctgtaagcttcgtacaaatgtgaagtattaatattatcgcagtattattgttgttattattattgttattattaacaatcttgggtgggtagtaggagagcaaaaagtatgaatgggatggagctaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaataaatgcgtgttcacacccacaaaaaaaaacaacgccgagcaaaaattcacctgaggggccacgctacgcgacccgctacgacacgggcca

SEQ ID NO: 100894 - DNA, 2064 bp, Homo sapiens
  misc_feature (2057)..(2057): n is a, c, g, or t
agcgggctcggggctcggctggcctcggctcgcctcgagctgcgctcggcaggctgcggtaaatccgggcttgcggccgctggcgtagtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggcgcagctccgcaccgcgctggcctctggaggcgtcctggacgctagcggcgattaccgcgtctacaggggcctgctgaagaccaccatggaccccaacgatgtgatcctggccacgcacgccagcgtggacaacctgctgcacctgtcgggtctgctggagcgctgggagggcccgctgtccgtgtcggtgttcgcggccaccaaggaggaggcgcagctggccacggtgctggcctacgcgctgagcagccactgccccgacatgcgcgccagggtcgccatgcacctcgtgtgcccctcgcgttacgaggcagccgtgcccgacccccgggagccgggggagtttgccctgctgcggtcctgccaggaggtctttgacaagctagccagggtggcccagcccgggattaattatgcgctgggcaccaatgtctcctaccccaataacctgctgaggaatctggctcgtgagggggccaactatgccctggtgatcgatgtggacatggtgcccagcgaggggctgtggagaggcctgcgggaaatgctggatcagagcaaccagtggggaggcaccgcgctggtggtgcctgccttcgaaatccgaagagcccgccgcatgcccatgaacaaaaacgagctggtgcagctctaccaggttggcgaggtgcggcccttctattatgggttgtgcaccccctgccaggcacccaccaactattcccgctgggtcaacctgccggaagagagcttgctgcggcccgcctacgtggtaccttggcaggacccctgggagccattctacgtggcaggaggcaaggtgcccaccttcgacgagcgctttcggcagtacggcttcaaccgaatcagccaggcctgcgagctgcatgtggcggggtttgattttgaggtcctgaacgaaggtttcttggttcataagggcttcaaagaagcgttgaagttccatccccaaaaggaggctgaaaatcagcacaataagatcctatatcgccagttcaaacaggagttgaaggccaagtaccccaactctccccgacgctgctgagcccttccctcccctaatctgagaagtcagcctcttggctcctcaggccaccatttaggcctgactggggtaagaaatgtcgctccactttacagaggtagctgtggtgttgaaacactggacttggatatggggtgctgggatcgattcctagctttaccactaactagctgtgtggccttgagtaaatcccgttacctctctgagcctcggttaccctgtctgtaaaaagggaggtgagaatacctacctcacggaactgttgggaggctcagatgagatgctatatgtgaaaacattctgtaagcttcgtacaaatgtgaagtattaatattatcgcagtattattgttgttattattattgttattattaacaatcttgggtgggtagtaggagagcaaaaagtatgaatgggatggagctaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaatgtgcgccggagatcctgcngagtcga

SEQ ID NO: 100895 - DNA, 2089 bp, Homo sapiens
ctgttctaaagctgcggcactgcttgggctacggtggtagtactgtggcacgttgtggccgtatgttgatgcactgccgtagccacggcagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggcgcagctccgcaccgcgctggcctctggaggcgtcctggacgctagcggcgattaccgcgtctacaggggcctgctgaagaccaccatggaccccaacgatgtgatcctggccacgcacgccagcgtggacaacctgctgcacctgtcgggtctgctggagcgctgggagggcccgctgtccgtgtcggtgttcgcggccaccaaggaggaggcgcagctggccacggtgctggcctacgcgctgagcagccactgccccgacatgcgcgccagggtcgccatgcacctcgtgtgcccctcgcgttacgaggcagccgtgcccgacccccgggagccgggggagtttgccctgctgcggtcctgccaggaggtctttgacaagctagccagggtggcccagcccgggattaattatgcgctgggcaccaatgtctcctaccccaataacctgctgaggaatctggctcgtgagggggccaactatgccctggtgatcgatgtggacatggtgcccagcgaggggctgtggagaggcctgcgggaaatgctggatcagagcaaccagtggggaggcaccgcgctggtggtgcctgccttcgaaatccgaagagcccgccgcatgcccatgaacaaaaacgagctggtgcagctctaccaggttggcgaggtgcggcccttctattatgggttgtgcaccccctgccaggcacccaccaactattcccgctgggtcaacctgccggaagagagcttgctgcggcccgcctacgtggtaccttggcaggacccctgggagccattctacgtggcaggaggcaaggtgcccaccttcgacgagcgctttcggcagtacggcttcaaccgaatcagccaggcctgcgagctgcatgtggcggggtttgattttgaggtcctgaacgaaggtttcttggttcataagggcttcaaagaagcgttgaagttccatccccaaaaggaggctgaaaatcagcacaataagatcctatatcgccagttcaaacaggagttgaaggccaagtaccccaactctccccgacgctgctgagcccttccctcccctaatctgagaagtcagcctcttggctcctcaggccaccatttaggcctgactggggtaagaaatgtcgctccactttacagaggtagctgtggtgttgaaacactggacttggatatggggtgctgggatcgattcctagctttaccactaactagctgtgtggccttgagtaaatcccgttacctctctgagcctcggttaccctgtctgtaaaaagggaggtgagaatacctacctcacggaactgttgggaggctcagatgagatgctatatgtgaaaacattctgtaagcttcgtacaaatgtgaagtattaatattatcgcagtattattgttgttattattattgttattattaacaatcttgggtgggtagtaggagagcaaaaagtatgaatgggatggagctaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaataaatgcgtgttcacacccacaaaaaaaaacaacgccgagcaaaaattcacctgaggggccacgctacgcgacccgctacgacacgggcca

SEQ ID NO: 100896 - DNA, 349 bp, Homo sapiens
acagcactccactggaagctgagtctccagaaagaccaaccctttgttagaagtttggaactttcagctgcaccccctcaacctcagagaagggagaaaggctggattgagttcaagcaccagtggccaatgatttaatcaatcatgtctacatagtggaagctcataaaaatccctaaatgatggggattggagagtttccaggtgggtgaacacactgaggtactgggaaggcagcatggaaactcggcacctcttcacctcccactacctcgccctacacatttcttccatttggctgttcctgagttgtatcccttataataaaccattaatagtaagtaaaatc

SEQ ID NO: 100897 - DNA, 397 bp, Homo sapiens
gggaggagaccagggaagctgggctagcagattctgaaacatgactcacgaactgggaccagagagcgtcaggggtctggggacaaatgtgcccttgacgtgggggccggtgactagagcgagaaaattcaggggagttgaatttgggcactggacaaaatgcacttggcacccagggccgtgggagggggtggggaatgctggaccaccgcgtcgggtggctcagcctggcagaaatcagtgcagggacctttaactccaaacgcagtcagctaaaggcgagaggcctgggaacacggacgtgacccagtgaatccagagaccaaccagatggtctccagaacaggaccctgggagctggaggtcaggacgggagcgtctgctcaagtgagcccgg

SEQ ID NO: 100898 - DNA, 310 bp, Homo sapiens
gcggccgcctactactactaaattcgcggccgcgtcgacaaattttatgtcaggcaaggtggctcacacctgtagtcccagcacttttgggaggttgaggcaggaggatcccttgagcctaggagtttgagaccagccctggcaacatagaccagcagctctacaaaaaataaagaaaattacctgggcatggtgggtggcacatgcacttgtagtcccaactagggaggctgagttgggaggactgtgtgatcctgggaggtcaaggctgcagtgatccatgatcacatgagactctctctcaaaaatt

SEQ ID NO: 100899 - DNA, 223 bp, Homo sapiens
ataataggatccacttttttgtaaaactatcaccaaaagcccctactaataaaatacgtgattctatgtgcctggatagagttagaagcatgagaaaaatatacaaggatgcatattaagttacatactaagaatgcagcatgtatgatttatagcgtagcatggactgctacagttagagaaggcaggtaagttgaaagagccaatgaaataagaaaaaggc

SEQ ID NO: 100900 - DNA, 703 bp, Homo sapiens
aagagcaatggaaatagactgacaaagaagttgaggtaagttgtgaaagcataattgacaaatatttggatatatgaagaatgaggaagagagagtagattaatcaaaattactgtgtgagaggatggtgatgccactggtaataggaagagaagatttagagggaagatttggacatagttgaagatgctggtagcacattgaagcattgtgtcttgcgcatatagctttacaaaatggccattgtgctggatattctttttgcccttcctgatctattttccatctttatctctcttgttctgtgttcctgggaggctgacaaataaagaactgcatactctcttttctggctttattcatggtgggtttggacagtgatagaaaagtgaggctgaaatatttgctccttctctttctcatatacttagcaagagattgtgagtggccacagctctgctccagtggccctcttatagctctaggtcttttctggcttctcgtaactgtctcctattgctagattctctagtcccaagaaggttcaaaccttgttgatttgccttaactgtgcccatacccttgtaaatagttccttttattaaaactcttcaataactgaatatactgtggtcatctcttcagtgaaattaaaaaaaaaaacttctttcacattttcttatgacttgatcttcccacacca

SEQ ID NO: 100901 - DNA, 398 bp, Homo sapiens
actgactgcaggtgattttttatttcctttttcctcctctaatttcctaatttttataacgagagtgttttactaattttttaaagcatcttttttgtgtatgaattaaggatggttacaataactaaggtggaaataaatgaagtttataactcagataatttagtcaaaatcaaattagtttgtagccataaacaatgactatcaaaggcccttatgcaaaaaaaaaaagtaagcttctgcagtccttaaattaagagggtttctcaagcctgtaatcccaatactttgggaggctgaaacaggaggattgcttgaagctagaagttcaagaccagcctaggtgacagtgtgcaacccagtctaaaaataaaaaataattttaaaaaattaccatt

SEQ ID NO: 100902 - DNA, 776 bp, Homo sapiens
gaggtgtgccttccaccagagacccagtcttgcaaggcagttattaaaaagtctcactttcgctgtgtccgtacctctaagtccattcttgggttggacacgtgagtgtgtttctcacaaacctgggggcctgtccgggatctctgtgcctgtgtggagtgggactccagctgagaggggagacgcgtcccacccgatttaggtggcctactctgtctgggcagtacaagctccccacaaaagccatagatcaactggagactgttactcaggagacactggaggtgacacagggagaaaagcaggcaccgtggcaacgaaggcaacctcttgcatcagccaaggttaaaaggacttctgactcaaactccacttctagagttcaggttcagcacttccagcccggcgacttggtgctgattaagacttgggaagaagacaagctccaccaaactgagaaggtccctaccaagcgctcctgaccactgagacagctgtgtgaacagtggaacggggatggaagaattgtctgaagaggatgagtgatcaccttccaggtggaggacttggaagagagagactaatgccaatagagctgcctgagctcatgacagagaatgattctaccccagtgacaagactttcaaagttccctattttgtttcatctgaaattccagaaaaactgaagaaatcaagatattaaagtgatattataaatgctatttccagagttcacaacataaaaatagacagtaaacttcattgttgtactag

SEQ ID NO: 100903 - DNA, 2251 bp, Homo sapiens
ttcccaattctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctatctgtcctttgtttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtca

SEQ ID NO: 100904 - DNA, 523 bp, Homo sapiens
  misc_feature (25)..(25): n is a, c, g, or t
  misc_feature (32)..(32): n is a, c, g, or t
  misc_feature (50)..(50): n is a, c, g, or t
gggaaaactttttaattaaaccccnaataaanaggtggggaattttgaantaaacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtca

SEQ ID NO: 100905 - DNA, 2197 bp, Homo sapiens
ttcccaattctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctatctgtcctttgtttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtca

SEQ ID NO: 100906 - DNA, 405 bp, Homo sapiens
tctttttgtagagacaaggtctcgctgtgttgcccagattggtttcaaactcctgcctcagcctcccaaagtgctaggattacaggtgtgttccaccttgccctgccacattctcacttttagagtagtcttttggctgggggagagagtctcaacagagcatttgttagtatgcaaatatgtcactttgagagggaggatacatggttatcatagggatgagtttagtaagttacataagataactgagtttccatagttaaaaaaaaagagaaaagggatatggagacaccactataaacacctatcttgattgaggtgaggagccctagcctgtatggggcagcaggaggttcaccctgtctgttgggaaggaggaaactctaagacgcaggaaaattggca

SEQ ID NO: 100907 - DNA, 355 bp, Homo sapiens
acatcccaggtattaagcccagtacccgatacttatcttttctgtttctcttcctcctcccaccctccaccctcgaggaggtcccagtgtctgttgtttccttctttgtgttcataagttcttgtcatttagctcctatttataagtgagaacatgtggtatttggttttctattcctgcgttagtttaccaagcatgatagcctccagctccatccatgttcctgcaaaaggcatggtctcatagccacaattgttattgagcagaagtaaaaccatctactaaaaattatcactatctcttcaataataggagtgtctgaagaatttttggctgaatacaaccatggattaaa

SEQ ID NO: 100908 - DNA, 454 bp, Homo sapiens
aaatcctcctggggccttcggagatccttccatctggaccagtgcacagaattccctttacatcttttgggatacaccctaaagaagatccagtctttgttcaccttcacgagtttcttcaatgtgaaagctacaggaggctttgttcaaagaaactctgacccagaaacccaacatggaagcaggcagagcaggacacttttatcttcaggtggctgggggaaaggaaggcttcacaaggtgcacactaaaaaccatgggcctactgtgactgacgccatgctccacaggacagcagaacggctcaggagctgcctccagaatcatatggcaactagttcaacagaactgtgatagacttggaaatgcatgttttgaagagctgtcattcacagcagcttgaaaaagcccccactggccaaatctggaacaatctgagcggcaaaataaacaa

SEQ ID NO: 100909 - DNA, 189 bp, Homo sapiens
ccatttgcattctggttgcttccttttttgaaagaagggcagagctacctctctagtatgcagaggtgtgcagcctaaatgagaaggtattcaagaccctactagtgtctgacataataaatgtcaacttcattgacgcagttcttggtataaccaaaaaagcttgagatggccatgattatgtatgac

SEQ ID NO: 100910 - DNA, 1021 bp, Homo sapiens
  misc_feature (1012)..(1019): n is a, c, g, or t
gctgtggcctctcctagcgaggggacatgactcctgcagaagtcctggctcaccgtccagtctgcatgcagggccaggccaggtgtgcccatgtccagttccttcctgcctgagcctttacctgccaagagcctgcaacatggggttcccttgtcccttgactcttctctctcttccctcctagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaannnnnnnnaa

SEQ ID NO: 100911 - DNA, 1376 bp, Homo sapiens
  misc_feature (307)..(307): n is a, c, g, or t
  misc_feature (493)..(493): n is a, c, g, or t
  misc_feature (1367)..(1374): n is a, c, g, or t
ggcagtgggactgggtttgagctgggcttatcctccaactgtgagggaggctacagcacactccaccccactctcagggctgggaattgttgtggctcagctatttgggggaatctgttttccagtttctcagaaccagcgcaagcacacacatcccaggctcacacccctggtggctggacttgctcccggatagcctcagtcagggagaggcagagctgcctggagcctgctgggctggtggaagccttggtggattctggcaggccaattatagacgaatggcctggggaacccgtgcagcccntggctgagtggttctaagccccagcacgtctgcctctggcttcacccagcctccttttctaactgcccttctctcctccccatcagtgaggaccagacaccactgattgcaggaatgtgttccctccccatggcaagatactacataattaaatatgcagaccagaaggctctatacacaagaganggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaannnnnnnnaa

SEQ ID NO: 100912 - DNA, 649 bp, Homo sapiens
atgctggtagaggacagacagtgaacacatgcacggtgcagctgtcagcacctcatcagaacaatgagcacatcagagtcagacacagtgaagggactaaatgacatgaccccttagtgttcttccaaacccaagagtctgtgtcatctatgaacacaggagtctcccttaacttttttggtttttgcaatctgcttttatgtagttttatgaggaagttttcttttattcaagacctctgccaggtgggtggtgagagcagagtccagcaagcattccaatgtgctaaaggaaagagaagtgttgtattcctggaggccccaaggaccactggcccctaaagtcagagaggggaagggccatgccaatttcagctgtcaaatcaagtgacaaaacttctaagaacttcttaaggcaggtatagcatcatttccttgccatctcatcagtctcagggtggtgtgcctgatgcataactgcctctgatagggtaagtcctaccagggtttttgaaggacacagggtattagtagaatcatccctactcctgcttgtgccaagtcagcccaatttctgactgcttataaccaagctcagccgttcagacatgccaaagactaccacaaaatatttgcagatctcagtagga

SEQ ID NO: 100913 - DNA, 530 bp, Homo sapiens
caggaagacaaggaatgcacaaaaaccaataaatgcaagagctgtataccagaacacttgaataagagataatatctcactatgagaatttcagttcaaataaacaaaaatttaattgccctcagtaatgtaataagataaatttttaagagaatgaaatggaagtagtaggcctgagcactttgttttaaatgcacagatttgaatacacaccatttcgtagtaaatacttttgacgtaaattttacatacagcatcctcagattatggtgcaatgaaattggaaatgaataagaaaacaacaggttttcaaccaaatgaaaaagagaaacatactacaataaaactatactacttgaaagacataaaaaatccccatcaccaattatccagctcatgaggctagcatagcttaactcataattttgttcaactctacatgccaatttcaacaagaaaaaatagagcatatataatgtactggttaatcccaaaaggacctaaaaaagaacagagtaagatagacaaaa

SEQ ID NO: 100914 - DNA, 558 bp, Homo sapiens
tgagacagagtcttactctgtcacccaggctagagtgtgacgttgagatcttggctcactgcaacctctgcctcctgggttcaagcaattctcctgcctcagcctcccaagtagctgggactacaggtgtgctaccatgcccagctaatttttgtagttttagtagagacaggatttcattattttggccaggctggtctcaaactcctgacctcagatgatctgcccgcttcagcctcccaagtgctgggattacaggcataagccaccatgcccaggccagaatttgcccatttttaatgcatgttctccacctttcatagaaaaagccatatatcctactaagctatttatgaagaccacaggttctagcccatgacaagcttgttatcctttctaaacacacaacccccaaatctagtcagcaaacttgaaggtctagggtgatggtcatgaaaggaatcaaacaaaagaatcttggaggggtctctgcaaattcatcgactccattaaggaatattcaacaacacagaaacttaaatccaggtaatattaaag

SEQ ID NO: 100915 - DNA, 447 bp, Homo sapiens
ttaaccagatctaaaaaaaaccctctcaaatatgtaatctattattttcagaagccctaagagaaaggcaaataatctcttctctatagtaactgaggggaaaacagtttaccatatttgttctgaaataacaaaacccaaggaggaacaactctctctgaggtaagagggcatcacaggagggatttcaatccttcctagtactgggaggagaaagtgcccttttctccaagaggaaagaatctatttatcatcaaacaaacaatgtgggagagttcatagctgcacaagtgttttctgggcgaagtaaaatgaatcatggattaagctatttggaaaaaagtgtgaaaacagaggagttgataccaaattaaaacgacttttggaaatatcatgtacgtatggaacaagtgcaaagggaaccactgactcagcgtcagaaatgcc

SEQ ID NO: 100916 - DNA, 2376 bp, Homo sapiens
gcttaagttgacctctgggtccggaatcgcgggcaaagatggcggcggccaggtgttggaggcctttgctacgcggtccgaggctttcattgcacaccgcggctaatgccgccgccacggctacagaaacgacctgccaagacgtcgcggcgacccccgtcgcgcggtacccgccgattgtggcctccatgacagccgacagcaaagctgcacggctgcggcggatcgagcgctggcaggcgacggtgcacgctgcggagtcggtagacgagaagctgcgaatcctcaccaagatgcagtttatgaagtacatggtttacccgcagaccttcgcgctgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataaatgcagaaatcccaaataaaatgctaacatactgaattcagtaattaaaagaacccactgcagctgggtgcaatggctcatgcctgtgatccacccacctcggcctcccaaagtgctgggattacaggtgtgagccactgcacctggcctatttacatcttatttcttagcaacgtttagagtttcttttatctccatgcatttcctgtgtatgcctacatttttgtgtaattggaaatggactttttctttccaattatatacttctttatagtttttaaaagtggctttatataggtgatactgatagctatatatttatcttgtaaaagaccaatttaagttgttcattagagccaataatttgtcagctgattctcatgaggtgtatataaccaatctgatttgcgttcttctgaaactgcttatcaaatagatggccattagcccctaaatggcaaaatccactggacagttttctgtattgtactcagtaaggtctgacatattttgcatgtttgaccgctccttcatttttaaaatagtttttttattgccttcagtgaaacatgctcttggttttcctcctatctcatttgctgttctgtcatatttctgtttgctgttcttcctctcacttttcttcaaatattggtgtacttttttttcttttctagactccatttttgtttaaccacactctccctagatgattttatcaaattccatggatttaaatata

SEQ ID NO: 100917 - DNA, 1887 bp, Homo sapiens
gccaaatggaagagcagtggtgatgaagagaaacgccacttaagagagtggggcgggccaggtttcctgttggctgttccaccacaaagctgtgtgaccatgtgtcacatggctgagtagtaacttctttttaccttaattttaaatttaattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataaatgcagaaatcccaaataaaatgctaacatactgaattcagtaattaaaagaacccactgcagctgggtgcaatggctcatgcctgtgatccacccacctcggcctcccaaagtgctgggattacaggtgtgagccactgcacctggcctatttacatcttatttcttagcaacgtttagagtttcttttatctccatgcatttcctgtgtatgcctacatttttgtgtaattggaaatggactttttctttccaattatatacttctttatagtttttaaaagtggctttatataggtgatactgatagctatatatttatcttgtaaaagaccaatttaagttgttcattagagccaataatttgtcagctgattctcatgaggtgtatataaccaatctgatttgcgttcttctgaaactgcttatcaaatagatggccattagcccctaaatggcaaaatccactggacagttttctgtattgtactcagtaaggtctgacatattttgcatgtttgaccgctccttcatttttaaaatagtttttttattgccttcagtgaaacatgctcttggttttcctcctatctcatttgctgttctgtcatatttctgtttgctgttcttcctctcacttttcttcaaatattggtgtacttttttttcttttctagactccatttttgtttaaccacactctccctagatgattttatcaaattccatggatttaaatata

SEQ ID NO: 100918 - DNA, 1900 bp, Homo sapiens
attttaaccttatactcaaaattgacttagatttatataatagaattgaatagaggaagtgggagtaggagtagatggaattagacaaagtaagaagtaactttcttgaagatggtagaatggcactgtttacttttgaaagataaagtacttctttttacaataaaataaattacatatgtcaacagtattactcatttgctatctccattaaagatgacataaaatacgtgtggagaaataaagttactacttggccttggtaattgggtaatgacatagtaccagatgtagaaagcatctgtgtagataaagcttgctgctcttagatgaagtaaataagactgatgttgttgaaaaagattaatcatgagattgaggatactagaagggaggaaaatattatttgtgcagaaataaaatatagggttagaatagagatgataaggaaactttgaggtcttcagggattttgttacataaagtatctaagttgtaggaggtatttgataccctctaatgtctaatgtgattgttttgtttgggtaagatatattctatgtgtaaatttcagcataactttcttctacaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataaatgcagaaatcccaaataaaatgctaacatactgaattcagtaattaaaagaacccactgcagctgggtgcaatggctcatgcctgtgatccacccacctcggcctcccaaagtgctgggattacaggtgtgagccactgcacctggcctatttacatcttatttcttagcaacgtttagagtttcttttatctccatgcatttcctgtgtatgcctacatttttgtgtaattggaaatggactttttctttccaattatatacttctttatagtttttaaaagtggctttatataggtgatactgatagctatatatttatcttgtaaaagaccaatttaagttgttcattagagccaataatttgtcagctgattctcatgaggtgtatataaccaatctgatttgcgttcttctgaaactgcttatcaaatagatggccattagcccctaaatggcaaaatccactggacagttttctgtattgtactcagtaaggtctgacatattttgcatgtttgaccgctccttcatttttaaaatagtttttttattgccttcagtgaaacatgctcttggttttcctcctatctcatttgctgttctgtcatatttctgtttgctgttcttcctctcacttttcttcaaatattggtgtacttttttttcttttctagactccatttttgtttaaccacactctccctagatgattttatcaaattccatggatttaaatata

SEQ ID NO: 100919 - DNA, 728 bp, Homo sapiens
gccatgttggttaggctggtctcgaactcctgacctcaggtgatccacccacctcggcctcccaaagtgctgggattacaggtgtgagccactgcacctggcctatttacatcttatttcttagcaacgtttagagtttcttttatctccatgcatttcctgtgtatgcctacatttttgtgtaattggaaatggactttttctttccaattatatacttctttatagtttttaaaagtggctttatataggtgatactgatagctatatatttatcttgtaaaagaccaatttaagttgttcattagagccaataatttgtcagctgattctcatgaggtgtatataaccaatctgatttgcgttcttctgaaactgcttatcaaatagatggccattagcccctaaatggcaaaatccactggacagttttctgtattgtactcagtaaggtctgacatattttgcatgtttgaccgctccttcatttttaaaatagtttttttattgccttcagtgaaacatgctcttggttttcctcctatctcatttgctgttctgtcatatttctgtttgctgttcttcctctcacttttcttcaaatattggtgtacttttttttcttttctagactccatttttgtttaaccacactctccctagatgattttatcaaattccatggatttaaatatatttgtaagcacattcaaaattagtttgatttc

SEQ ID NO: 100920 - DNA, 1465 bp, Homo sapiens
gcttaagttgacctctgggtccggaatcgcgggcaaagatggcggcggccaggtgttggaggcctttgctacgcggtccgaggctttcattgcacaccgcggctaatgccgccgccacggctacagaaacgacctgccaagacgtcgcggcgacccccgtcgcgcggtacccgccgattgtggcctccatgacagccgacagcaaagctgcacggctgcggcggatcgagcgctggcaggcgacggtgcacgctgcggagtcggtagacgagaagctgcgaatcctcaccaagatgcagtttatgaagtacatggtttacccgcagaccttcgcgctgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagaca

SEQ ID NO: 100921 - DNA, 2296 bp, Homo sapiens
gcttaagttgacctctgggtccggaatcgcgggcaaagatggcggcggccaggtgttggaggcctttgctacgcggtccgaggctttcattgcacaccgcggctaatgccgccgccacggctacagaaacgacctgccaagacgtcgcggcgacccccgtcgcgcggtacccgccgattgtggcctccatgacagccgacagcaaagctgcacggctgcggcggatcgagcgctggcaggcgacggtgcacgctgcggagtcggtagacgagaagctgcgaatcctcaccaagatgcagtttatgaagtacatggtttacccgcagaccttcgcgctgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataaatgcagaaatcccaaataaaatgctaacatactgaattcagtaattaaaagaacccactgcagctggcctatttacatcttatttcttagcaacgtttagagtttcttttatctccatgcatttcctgtgtatgcctacatttttgtgtaattggaaatggactttttctttccaattatatacttctttatagtttttaaaagtggctttatataggtgatactgatagctatatatttatcttgtaaaagaccaatttaagttgttcattagagccaataatttgtcagctgattctcatgaggtgtatataaccaatctgatttgcgttcttctgaaactgcttatcaaatagatggccattagcccctaaatggcaaaatccactggacagttttctgtattgtactcagtaaggtctgacatattttgcatgtttgaccgctccttcatttttaaaatagtttttttattgccttcagtgaaacatgctcttggttttcctcctatctcatttgctgttctgtcatatttctgtttgctgttcttcctctcacttttcttcaaatattggtgtacttttttttcttttctagactccatttttgtttaaccacactctccctagatgattttatcaaattccatggatttaaatata

SEQ ID NO: 100922 - DNA, 413 bp, Homo sapiens
tcctggaactcctggactattctattccaagttgctacttcctgagagggtcactggatgtcccccttggagaaggaatcaccttggattaccatctttaaatcttaaagggatttttctcataggtattctacttaagtacagacaaataatttaatcatcccatagtgtatccaccatatttgtggcttgtaaatgttttaaaacttgggcataagtagctgataagttacaaaaaagatacaaatttcaataaggtaattttagttaaagtgacaggaaatgggggtgcattttgaatagaaaaacacagaactccaaaaacaagacaaaaaaccatgttatttccaaagagaacatctcagttgtgcagaaagaattaacatagcaggcctgattgagactgatatgct

SEQ ID NO: 100923 - DNA, 374 bp, Homo sapiens
atacaaaaaataaattagctgggggcgtggtggcatgcgcctgtagtcccagctactcgggaggctgaggcaggagaatggcatgaacccaagaggcggaggttgcagtgagctgagatcacaccactgcactctagcctggctacagagtgagactccatctcagaaaaacacacacacacacacacacacaaacagaaaagggtagaatcgccctgttgaagggaaagtggggggtctaggcacttggttatgctttataaacttcttctgctcctccccaagcaataggttctagatgcgagggttctaggtggagggaggccttagaacatgtgtgccctgaattcgttcaccttcccagagttcattcc

SEQ ID NO: 100924 - DNA, 4788 bp, Homo sapiens
tcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccaggtgagcccacccttcctccccagcccagccccagcccagcccagcttggcccagtctccataacaacatctcctggagcccgcagagagatcccagccctgcccaatcccttcaccaccacaagcccctgcctatctcggggacccccaagaactgggagacttgtggctggaaggcagagacccccctcccccagcccagaccctccctcacatatccagaaaggcacacactgtggggaggtagatacccagccagagaaaggtcccacttctgagggaggtacaggaactgtcacaccctcctggaaacggacacacgacatggggggacagacacggagggtggggcactcagacacaccaatgcacactcactcggggaagcatgacatgggatcagacagcctcaccctgagatctgtacagacacagatagatggactgaccggccatgaactctggccggcatacccctgcctgcttcagccgaggcttggtaccactgctgggggaaggtggcatgcgtgcatcccacgggcagcatggagggagccacgactccccaaaaatcctgtcgctaagagacggtgccagtgctgccaagaagtgtgaaaacaggggaggtggggagggatgtgaggcttgtcacagttagagctcctgccaggagcctgaaggagctttcagcagagccctggtcctgcctcccagcccaccaccactccttttccatcagctagccagaaggggaatgggggtagggagtggatagggatagccagcaggggactttccaacctgtctcctgcccactgcagactccacttctgagacccatcctcttcagaactccagaggcctctccaccccctgccccacccccttgccctagtttagctccctcgtgccaagactgagtgcagcgctggcacaacaccagtcgggaaatagcagaaggtgctgaggcggcagaaagtgtagatcaatcgatggcctaggagccaagactgccaggaacatccccaccccaatccttcagccctctccagccccatccacgcatacctaggccagcagcacagggcttctgagcaggagtgggaggctcaggtcctctgccctcccctgctcagaactctggtgaagctgaggaagcaggaggtccgtgaggccccagggtctagggaaggaggttaaggggtggggcccagggaccctagaggatagacccctctgctggcaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggaggtgccacaaataccccacccccagaatcccacccagatccctgggagaatcctgagggtgatgctgaagagaccaccataggtgataggaagtggagagggtggaaagcacctgggctcagctgaaggacggaaccatgggggtcttgctctgggaggctctgctggaagggagaaagaggggtcacctgatggacttgtgaccctgagcttgtggggtggggtctagatgcagtgggactgtatcaaccccaagtatcgggacaagaagaagaattacaagagctcagggacggtagtgctggcccagtgcacggtaaatttcacttcctgcttcaagccttgccccagcccctgcccctaccacactctcaggttcaacccttcccttgtttcaaagaccagtttctctgcttctgggaactggaaaccacccccaactgcaacccaaaaaactctggctcccccatgttccccacagaagccctacccaagctccctcctcaaaggaccaccccatcccctcgccttacccctctccctacctccaggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcactgcctccaatggggacccgaggagcagccagtccctgcactgcctcagtccccgacagcccaaccactacctgcaggccctgcgtgcagtgggaggcatctgccaggactatgacaggtaggagagagtggggcgggagggaacaggcagggaggccttgcccaacggattccacagctttttcttctccccagtgataagcggttcccagcttttggctttggggctcgaatcccccccaacttcgaggtaggctagatgcgagggaaagaaggagatggggggcgtgtcagtcaggcagaaaaggcaggccctcactgctcccgccttgccctcacaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgtgagtcccccgggccccttccggctgaaggactcctcagcttctcatccccccaaatctgaccttcgtcttccaccatttgatgtcctgctaaggacgcgggagcccagctggccaccctgaagccccacttctccctcagatgaccctgcctcccctactcttcctctcacccctaaccacatcactgtccccaccctaggctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgagtcctggggcttccaaaggagtggacacagggggtgcaaagtggggcttggtagagcccaactaggctgggtgtagtgtagaagagagtgcttatgactctcccaccccctcccgtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagc

SEQ ID NO: 100925 - DNA, 3919 bp, Homo sapiens
  misc_feature (1213)..(1213): n is a, c, g, or t
tcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacggtaggcaagatcacctgtactcacccttggtccaggtattcaatgcccctgcatggacacctatggtgacatcatgcccaggaccacccccacctaagggaaaggggatggggtggcccttgtggtaaggttaggggagtcctgccacttgtatcccccttgcagatcgtggccgaggaggtatcaggcacaaacgactatgtgcaactcaccttcagagcctacaagctggacaacaaggttggaaccccagagtccaggcccccaactcccctgtcactcctaggcctcccactcaagacagatcccaggagcccaggcctgctctcttcccagtggagcccatcccccaccctccttgcagctctcaccaacctcaagggccctttctcctgtatcttcaggatctgttcagcaagtctgaccctttcatggaaatctataagaccaacgaggaccaaagtgatcagctggtctggagaactgaggttggtgcctggggctatggggatgaagggagggagagtaaagtaagaanacacagacaggagctgaccagccacctggtgcctctccaaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggaggtgccacaaataccccacccccagaatcccacccagatccctgggagaatcctgagggtgatgctgaagagaccaccataggtgataggaagtggagagggtggaaagcacctgggctcagctgaaggacggaaccatgggggtcttgctctgggaggctctgctggaagggagaaagaggggtcacctgatggacttgtgaccctgagcttgtggggtggggtctagatgcagtgggactgtatcaaccccaagtatcgggacaagaagaagaattacaagagctcagggacggtagtgctggcccagtgcacggtaaatttcacttcctgcttcaagccttgccccagcccctgcccctaccacactctcaggttcaacccttcccttgtttcaaagaccagtttctctgcttctgggaactggaaaccacccccaactgcaacccaaaaaactctggctcccccatgttccccacagaagccctacccaagctccctcctcaaaggaccaccccatcccctcgccttacccctctccctacctccaggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcactgcctccaatggggacccgaggagcagccagtccctgcactgcctcagtccccgacagcccaaccactacctgcaggccctgcgtgcagtgggaggcatctgccaggactatgacaggtaggagagagtggggcgggagggaacaggcagggaggccttgcccaacggattccacagctttttcttctccccagtgataagcggttcccagcttttggctttggggctcgaatcccccccaacttcgaggtaggctagatgcgagggaaagaaggagatggggggcgtgtcagtcaggcagaaaaggcaggccctcactgctcccgccttgccctcacaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgtgagtcccccgggccccttccggctgaaggactcctcagcttctcatccccccaaatctgaccttcgtcttccaccatttgatgtcctgctaaggacgcgggagcccagctggccaccctgaagccccacttctccctcagatgaccctgcctcccctactcttcctctcacccctaaccacatcactgtccccaccctaggctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgagtcctggggcttccaaaggagtggacacagggggtgcaaagtggggcttggtagagcccaactaggctgggtgtagtgtagaagagagtgcttatgactctcccaccccctcccgtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagc

SEQ ID NO: 100926 - DNA, 3747 bp, Homo sapiens
tcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccaggtgagcccacccttcctccccagcccagccccagcccagcccagcttggcccagtctccataacaacatctcctggagcccgcagagagatcccagccctgcccaatcccttcaccaccacaagcccctgcctatctcggggacccccaagaactgggagacttgtggctggaaggcagagacccccctcccccagcccagaccctccctcacatatccagaaaggcacacactgtggggaggtagatacccagccagagaaaggtcccacttctgagggaggtacaggaactgtcacaccctcctggaaacggacacacgacatggggggacagacacggagggtggggcactcagacacaccaatgcacactcactcggggaagcatgacatgggatcagacagcctcaccctgagatctgtacagacacagatagatggactgaccggccatgaactctggccggcatacccctgcctgcttcagccgaggcttggtaccactgctgggggaaggtggcatgcgtgcatcccacgggcagcatggagggagccacgactccccaaaaatcctgtcgctaagagacggtgccagtgctgccaagaagtgtgaaaacaggggaggtggggagggatgtgaggcttgtcacagttagagctcctgccaggagcctgaaggagctttcagcagagccctggtcctgcctcccagcccaccaccactccttttccatcagctagccagaaggggaatgggggtagggagtggatagggatagccagcaggggactttccaacctgtctcctgcccactgcagactccacttctgagacccatcctcttcagaactccagaggcctctccaccccctgccccacccccttgccctagtttagctccctcgtgccaagactgagtgcagcgctggcacaacaccagtcgggaaatagcagaaggtgctgaggcggcagaaagtgtagatcaatcgatggcctaggagccaagactgccaggaacatccccaccccaatccttcagccctctccagccccatccacgcatacctaggccagcagcacagggcttctgagcaggagtgggaggctcaggtcctctgccctcccctgctcagaactctggtgaagctgaggaagcaggaggtccgtgaggccccagggtctagggaaggaggttaaggggtggggcccagggaccctagaggatagacccctctgctggcaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcactgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaaaaaaaaaaactcagatgccc

SEQ ID NO: 100927 - DNA, 3713 bp, Homo sapiens
tcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccaggtgagcccacccttcctccccagcccagccccagcccagcccagcttggcccagtctccataacaacatctcctggagcccgcagagagatcccagccctgcccaatcccttcaccaccacaagcccctgcctatctcggggacccccaagaactgggagacttgtggctggaaggcagagacccccctcccccagcccagaccctccctcacatatccagaaaggcacacactgtggggaggtagatacccagccagagaaaggtcccacttctgagggaggtacaggaactgtcacaccctcctggaaacggacacacgacatggggggacagacacggagggtggggcactcagacacaccaatgcacactcactcggggaagcatgacatgggatcagacagcctcaccctgagatctgtacagacacagatagatggactgaccggccatgaactctggccggcatacccctgcctgcttcagccgaggcttggtaccactgctgggggaaggtggcatgcgtgcatcccacgggcagcatggagggagccacgactccccaaaaatcctgtcgctaagagacggtgccagtgctgccaagaagtgtgaaaacaggggaggtggggagggatgtgaggcttgtcacagttagagctcctgccaggagcctgaaggagctttcagcagagccctggtcctgcctcccagcccaccaccactccttttccatcagctagccagaaggggaatgggggtagggagtggatagggatagccagcaggggactttccaacctgtctcctgcccactgcagactccacttctgagacccatcctcttcagaactccagaggcctctccaccccctgccccacccccttgccctagtttagctccctcgtgccaagactgagtgcagcgctggcacaacaccagtcgggaaatagcagaaggtgctgaggcggcagaaagtgtagatcaatcgatggcctaggagccaagactgccaggaacatccccaccccaatccttcagccctctccagccccatccacgcatacctaggccagcagcacagggcttctgagcaggagtgggaggctcaggtcctctgccctcccctgctcagaactctggtgaagctgaggaagcaggaggtccgtgaggccccagggtctagggaaggaggttaaggggtggggcccagggaccctagaggatagacccctctgctggcaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcactgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagc

SEQ ID NO: 100928 - DNA, 4766 bp, Homo sapiens
  misc_feature (2502)..(2502): n is a, c, g, or t
tcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccaggtgagcccacccttcctccccagcccagccccagcccagcccagcttggcccagtctccataacaacatctcctggagcccgcagagagatcccagccctgcccaatcccttcaccaccacaagcccctgcctatctcggggacccccaagaactgggagacttgtggctggaaggcagagacccccctcccccagcccagaccctccctcacatatccagaaaggcacacactgtggggaggtagatacccagccagagaaaggtcccacttctgagggaggtacaggaactgtcacaccctcctggaaacggacacacgacatggggggacagacacggagggtggggcactcagacacaccaatgcacactcactcggggaagcatgacatgggatcagacagcctcaccctgagatctgtacagacacagatagatggactgaccggccatgaactctggccggcatacccctgcctgcttcagccgaggcttggtaccactgctgggggaaggtggcatgcgtgcatcccacgggcagcatggagggagccacgactccccaaaaatcctgtcgctaagagacggtgccagtgctgccaagaagtgtgaaaacaggggaggtggggagggatgtgaggcttgtcacagttagagctcctgccaggagcctgaaggagctttcagcagagccctggtcctgcctcccagcccaccaccactccttttccatcagctagccagaaggggaatgggggtagggagtggatagggatagccagcaggggactttccaacctgtctcctgcccactgcagactccacttctgagacccatcctcttcagaactccagaggcctctccaccccctgccccacccccttgccctagtttagctccctcgtgccaagactgagtgcagcgctggcacaacaccagtcgggaaatagcagaaggtgctgaggcggcagaaagtgtagatcaatcgatggcctaggagccaagactgccaggaacatccccaccccaatccttcagccctctccagccccatccacgcatacctaggccagcagcacagggcttctgagcaggagtgggaggctcaggtcctctgccctcccctgctcagaactctggtgaagctgaggaagcaggaggtccgtgaggccccagggtctagggaaggaggttaaggggtggggcccagggaccctagaggatagacccctctgctggcaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacggtaggcaagatcacctgtactcacccttggtccaggtattcaatgcccctgcatggacacctatggtgacatcatgcccaggaccacccccacctaagggaaaggggatggggtggcccttgtggtaaggttaggggagtcctgccacttgtatcccccttgcagatcgtggccgaggaggtatcaggcacaaacgactatgtgcaactcaccttcagagcctacaagctggacaacaaggttggaaccccagagtccaggcccccaactcccctgtcactcctaggcctcccactcaagacagatcccaggagcccaggcctgctctcttcccagtggagcccatcccccaccctccttgcagctctcaccaacctcaagggccctttctcctgtatcttcaggatctgttcagcaagtctgaccctttcatggaaatctataagaccaacgaggaccaaagtgatcagctggtctggagaactgaggttggtgcctggggctatggggatgaagggagggagagtaaagtaagaanacacagacaggagctgaccagccacctggtgcctctccaaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggaggtgccacaaataccccacccccagaatcccacccagatccctgggagaatcctgagggtgatgctgaagagaccaccataggtgataggaagtggagagggtggaaagcacctgggctcagctgaaggacggaaccatgggggtcttgctctgggaggctctgctggaagggagaaagaggggtcacctgatggacttgtgaccctgagcttgtggggtggggtctagatgcagtgggactgtatcaaccccaagtatcgggacaagaagaagaattacaagagctcagggacggtagtgctggcccagtgcacggtaaatttcacttcctgcttcaagccttgccccagcccctgcccctaccacactctcaggttcaacccttcccttgtttcaaagaccagtttctctgcttctgggaactggaaaccacccccaactgcaacccaaaaaactctggctcccccatgttccccacagaagccctacccaagctccctcctcaaaggaccaccccatcccctcgccttacccctctccctacctccaggtggagaaggtgcacaccttcctggattacatcatgggtggctgccagatcagcttcacggtggccattgacttcactgcctccaatggggacccgaggagcagccagtccctgcactgcctcagtccccgacagcccaaccactacctgcaggccctgcgtgcagtgggaggcatctgccaggactatgacaggtaggagagagtggggcgggagggaacaggcagggaggccttgcccaacggattccacagctttttcttctccccagtgataagcggttcccagcttttggctttggggctcgaatcccccccaacttcgaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcaggtgaggcttccagggccgaggcccagcatctgcacccaactctccctgccaagggaccatccaactctcccactgcttaatgaaggaactcgaggggagggcagtcctcagacctggaagcatttccttgctttaaggagtgtcaggagggggccctgctcatttctgccagcttcacaacttctcttcactcacagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaaaaaaaaaaactcagatgccc

SEQ ID NO: 100929 - DNA, 3754 bp, Homo sapiens
  misc_feature (1048)..(1048): n is a, c, g, or t
tcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggttggaaccccagagtccaggcccccaactcccctgtcactcctaggcctcccactcaagacagatcccaggagcccaggcctgctctcttcccagtggagcccatcccccaccctccttgcagctctcaccaacctcaagggccctttctcctgtatcttcaggatctgttcagcaagtctgaccctttcatggaaatctataagaccaacgaggaccaaagtgatcagctggtctggagaactgaggttggtgcctggggctatggggatgaagggagggagagtaaagtaagaanacacagacaggagctgaccagccacctggtgcctctccaaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggaggtgccacaaataccccacccccagaatcccacccagatccctgggagaatcctgagggtgatgctgaagagaccaccataggtgataggaagtggagagggtggaaagcacctgggctcagctgaaggacggaaccatgggggtcttgctctgggaggctctgctggaagggagaaagaggggtcacctgatggacttgtgaccctgagcttgtggggtggggtctagatgcagtgggactgtatcaaccccaagtatcgggacaagaagaagaattacaagagctcagggacggtagtgctggcccagtgcacggtaaatttcacttcctgcttcaagccttgccccagcccctgcccctaccacactctcaggttcaacccttcccttgtttcaaagaccagtttctctgcttctgggaactggaaaccacccccaactgcaacccaaaaaactctggctcccccatgttccccacagaagccctacccaagctccctcctcaaaggaccaccccatcccctcgccttacccctctccctacctccaggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcactgcctccaatggggacccgaggagcagccagtccctgcactgcctcagtccccgacagcccaaccactacctgcaggccctgcgtgcagtgggaggcatctgccaggactatgacaggtaggagagagtggggcgggagggaacaggcagggaggccttgcccaacggattccacagctttttcttctccccagtgataagcggttcccagcttttggctttggggctcgaatcccccccaacttcgaggtaggctagatgcgagggaaagaaggagatggggggcgtgtcagtcaggcagaaaaggcaggccctcactgctcccgccttgccctcacaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgtgagtcccccgggccccttccggctgaaggactcctcagcttctcatccccccaaatctgaccttcgtcttccaccatttgatgtcctgctaaggacgcgggagcccagctggccaccctgaagccccacttctccctcagatgaccctgcctcccctactcttcctctcacccctaaccacatcactgtccccaccctaggctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgagtcctggggcttccaaaggagtggacacagggggtgcaaagtggggcttggtagagcccaactaggctgggtgtagtgtagaagagagtgcttatgactctcccaccccctcccgtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagc

SEQ ID NO: 100930 - DNA, 4068 bp, Homo sapiens
tcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccaggtgagcccacccttcctccccagcccagccccagcccagcccagcttggcccagtctccataacaacatctcctggagcccgcagagagatcccagccctgcccaatcccttcaccaccacaagcccctgcctatctcggggacccccaagaactgggagacttgtggctggaaggcagagacccccctcccccagcccagaccctccctcacatatccagaaaggcacacactgtggggaggtagatacccagccagagaaaggtcccacttctgagggaggtacaggaactgtcacaccctcctggaaacggacacacgacatggggggacagacacggagggtggggcactcagacacaccaatgcacactcactcggggaagcatgacatgggatcagacagcctcaccctgagatctgtacagacacagatagatggactgaccggccatgaactctggccggcatacccctgcctgcttcagccgaggcttggtaccactgctgggggaaggtggcatgcgtgcatcccacgggcagcatggagggagccacgactccccaaaaatcctgtcgctaagagacggtgccagtgctgccaagaagtgtgaaaacaggggaggtggggagggatgtgaggcttgtcacagttagagctcctgccaggagcctgaaggagctttcagcagagccctggtcctgcctcccagcccaccaccactccttttccatcagctagccagaaggggaatgggggtagggagtggatagggatagccagcaggggactttccaacctgtctcctgcccactgcagactccacttctgagacccatcctcttcagaactccagaggcctctccaccccctgccccacccccttgccctagtttagctccctcgtgccaagactgagtgcagcgctggcacaacaccagtcgggaaatagcagaaggtgctgaggcggcagaaagtgtagatcaatcgatggcctaggagccaagactgccaggaacatccccaccccaatccttcagccctctccagccccatccacgcatacctaggccagcagcacagggcttctgagcaggagtgggaggctcaggtcctctgccctcccctgctcagaactctggtgaagctgaggaagcaggaggtccgtgaggccccagggtctagggaaggaggttaaggggtggggcccagggaccctagaggatagacccctctgctggcaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcactgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcaggtgaggcttccagggccgaggcccagcatctgcacccaactctccctgccaagggaccatccaactctcccactgcttaatgaaggaactcgaggggagggcagtcctcagacctggaagcatttccttgctttaaggagtgtcaggagggggccctgctcatttctgccagcttcacaacttctcttcactcacagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaaaaaaaaaaactcagatgccc

SEQ ID NO: 100931 - DNA, 290 bp, Homo sapiens
aataaaaaggcattttcatagtacattctctcaaaaagttggtttttcactatctacaatggactggcttccagcaaaaatctctgtgctttgatctaatggtttgctttttagaataggtgaaacctaaactacttaatttccttcgataaacacaaaacctaccatttgtttagccagcaccttcccctgcccccagtaagtaagtaaaaatgcataaattgccctttctggtgagactattggaatttttttatgctaaggtccttacaatctctgaatttgtaagc

SEQ ID NO: 100932 - DNA, 369 bp, Homo sapiens
agcctctcctccttatgagctatgtgatgctgggcagttcacttggtaggcctcagtttcctcatctgtgaagtgggcatcgtatcagggcctcccccacagcaaggccgtgcatgtcacatgctgagctcagagtctagtccaggtgaacagtcgtttgagtgtttgtgagggaacaagtgagagacccagagaccaggacacagagagaaatacagggagatcgggctaggtgcggtggctcacgcctgtaatcccagcactctgggaggccgaggcgggtggatcacctgaggttagtagttcgagaccagcctcgccgatatggtgaaacccccatctctactaaaaatacaaaaattagctggg

SEQ ID NO: 100933 - DNA, 694 bp, Homo sapiens
ggggaggaagatctgagaggcagaatccacaccacttaggaaccaactgggtaggatgtagcaggagagtgggaggaaagaggctgggatggcttccaggacccagggagggaacacaaaaggggaagcagcagggagtgagcaggagaggaacatcccgaccctgtgaactgccaaatgctgtgtcacattctggtccgcaggtgtccatggccagtgtggcgtttagcaaaacatctgagtgggagacgtagattttcccgcatcaggtgtgagtgttgcgggacgctatggctttgaaggtgatagcctcgggggagcaagtgtgagaagagcagaggctgcacgtggagacccagggaatgcgaaagtctaggggaagtggacaggaggagagcagagcagcaggaaacaggcaggaggggggtcacagaagccaagtcagcgtgggtttccaggggaaagtggtctgcagtgtggaaggccatagagaagtgaggtacagactgaaaaggtgaccagacttggcaactagggggtgattggcaacttctacacaaatcgttctcatgaagtgctgcagatgagtttgaggcgtgtcattacccacgccctcagcagccaaacgaaaatagcctgggtggctcccagcatgggtgcccatgcatgctgctttgccttggtggaagaccaa

SEQ ID NO: 100934 - DNA, 211 bp, Homo sapiens
tcttatgtgcattaagttgtaaggattaaaggctttgccaaatttttcccatttgtagggttgctttcaagtataaattttcttatgtttagttagggctgaggaccaggaaaaggcattggcacattcttcccatttgtagggttttaaaccagtaagaattaccttatgtttagtaaagcttgaagacaggttaaaagatttgccacat

SEQ ID NO: 100935 - DNA, 677 bp, Homo sapiens
ggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccgcatctctactaaaaatacaaaaaattagacggggccaggtgccatggctcatgcctgtaatcccagcactttgggaggccaaggagggtggatcacgagatcaggagatcgagaccatcctggctaacaccccatctctgctaaaaatacaaaaagtagccaggcatggttgcgggcacctgtattcccagctactcaggaggctgaggcaggagaatggcgtgaacccaggaggcggcacttgcagtgagccaagatcataccatttgcactgtagcctgggctacaagagtgagactccgtctcaaaaaaaaaaaaaaatagctgggtgtggtggcacgcacctgtag

SEQ ID NO: 100936 - DNA, 720 bp, Homo sapiens
gataaatctcagttggtcatagtgtaaaattcttttaagggctgctgaatttaatttcctagtattttgttggggatttttgtatctataatgcattcataggggacatttggctatagttttcttgtattgtctgtctagctttggtatcagggtaatgttggcttcatagaatgactcagaaagggttctgtttctcaactttttggaggagttcgagaaggattagtgttaattcatttctaaacgtttggtagaattcaccagcgaagtcatcagttcctgggcttttctttgttaggagagttttggttgctgattcaatcagaattgaatatcattactttttatagatctattcagatttattctttgttcttgagtcaactttgttggtttgtatgtttctaggaatttgtctgtttcatctaggttatccaattttttgacatatagctcttatacgaattctcttacaatcctttttattcctataaatcagtagtagtgtttttcatttctgattttagtagttgagtattctttttccttaatctagttaaagctttgtcaactttgttgatctcttcaaagaactaattttttgtttcattgattctattgtttttctattctctatttcatttatttttgctctaatccttattatttccttcctctttatggcttcaaactcaattgaacataaagtattaagaa

SEQ ID NO: 100937 - DNA, 182 bp, Homo sapiens
tcccagcacttcccagctgtgtgacgtgggctggacgatacttaccctggcggccttcagcttcctcatctacatatgtttatagggttagtgatgacgaagtaagataataagataacagagagagagctctttggtaataggcatatgaaaaatgcaatcatgtttatattctaagcccc

SEQ ID NO: 100938 - DNA, 138 bp, Homo sapiens
ccacatgctgggtgcagaggatgcagaaggggatgaacctggcttccttccctgaagactctccccagctgaggatggaagctctcagggtttgttggatgggaaggagcaaatccctctcgagcccgtttaaataag

SEQ ID NO: 100939 - DNA, 839 bp, Homo sapiens
  misc_feature (610)..(610): n is a, c, g, or t
  misc_feature (619)..(619): n is a, c, g, or t
  misc_feature (624)..(624): n is a, c, g, or t
  misc_feature (640)..(640): n is a, c, g, or t
  misc_feature (644)..(645): n is a, c, g, or t
  misc_feature (648)..(648): n is a, c, g, or t
  misc_feature (651)..(651): n is a, c, g, or t
  misc_feature (654)..(654): n is a, c, g, or t
  misc_feature (658)..(658): n is a, c, g, or t
  misc_feature (669)..(669): n is a, c, g, or t
  misc_feature (671)..(671): n is a, c, g, or t
  misc_feature (675)..(676): n is a, c, g, or t
  misc_feature (683)..(683): n is a, c, g, or t
  misc_feature (691)..(691): n is a, c, g, or t
  misc_feature (696)..(697): n is a, c, g, or t
  misc_feature (700)..(700): n is a, c, g, or t
  misc_feature (707)..(708): n is a, c, g, or t
  misc_feature (717)..(717): n is a, c, g, or t
  misc_feature (724)..(725): n is a, c, g, or t
gaaaaatacagatctcaacctctaacccacaaaagaaagagagagctttaactgaactgactctcttattgaaccaccgctaccagggggagacatgacaagctttacgtgttgaaaatacaaagagcctgaccctacaggaatctttctttctggcctttttcatcttttagggtacatgtgcacaacgtgcaggtcatcattctcagcaaactatcacaaggacaaaaaaccaaacaccgcgtgttctcactcataggtggaaattgaacaatgagaacacatggtcacaggaaggtgagctggttttaaagaaatggagcctgcaggtaagggtgaagctaaagaaggctcaggaacaaagtaaatgtctgcagaagtttctctagctgtagaaccaagctcacataattccagtaatgagaagatccagaagcatttgaaagtattcatgtcaatgaacagccaaagtagagaaaagatgtatacagccaacatcttcatgccccaggagcccaagtttggagatctttgtttcattctcaaaggacagctttacttatccttccaatgatcactgccaagttctctttagccatgcaaatggttnctcttgacnattgnccctgaacacttgaanggannggnttnctncccnttaaaatgaangncctnntaaacancaaaagcncaagnnagntaaaacnngatacaggngcaaatnnattataagatctactaccgcttgcgcaaagcccagcttttaaagactagacgggaagggtggtattgtccctaagaaacaaacacgggcaaacgaacttgcccaaccatctgaa

SEQ ID NO: 100940 - DNA, 764 bp, Homo sapiens
tggggtttcaccatgttggccaggatgagcattgatctcttgacctcgtgatccccctgcctcgacctcccaaagtgttgggattacaggcgtgagccgctgtgggctgtgtggggggaaccggctaggtcctcaaagtatggtttctactggatgcatatcagttttgcaccatcagaaagtcaaaaagtcattaagttgagccatcatacgttggggactctctgtggtataaggtaatggtccagcctcattcttttgcatgtgaatatccagtttctccagcaccatttgttgaaccctcacatttttctagtgctcttctgttgaaatggtgctctgcaaacagtccctccacccatctcagctgcccaaacgaaaagcttaccaagggtcatccttggttcctgtccttccctcgtagtcttgcatcctgtcagtcgtccgtcagcaaattctgttgatttggcctcctagataaagtgtaatcccctttccactgccagcaccctgatcgaacaaccattgcttttacctggactgtgtcacagcctcctaacgggtcttcctgcttccacccttttcccctctctgatctgttttccacattgtagccagaatagttaaaatagaaatcaaaatagaactaaactcctcccatggcctacaaagcctgtgtgatccggcccctccacggctgagtcgtctcagtgtgctttagtcacgaggatcttgctggtttcactgagcactaagctcatcct

SEQ ID NO: 100941 - DNA, 412 bp, Homo sapiens
cacatttcacaagactaacatatctaaagtacaaatctgtttatacctcctctactcaaaatcttttaacagctctgttaactatcaaaaaagcctcagaacctggactgcaggcatttagggtaaagataaataagatgctaatttatataaaaaggaggtgaggtaaaggtatgctacagtgtcactggtaaaatataaagcgaaaactatctagaagattgcttctacttgaggaactttggacttggagttaattggtagctaggttttcaatttggctgttcctctgccttgtgtgtgattctatatgtgctatgacctccctgggctttagtgtcttactgtgtgatacgaagatggtagtgcctgttgtgtatatggtgatgtgtcagacttggcttctggtctc

SEQ ID NO: 100942 - DNA, 441 bp, Homo sapiens
ctgttgggagttttttgtttgtttcgattttttttctttgcagttaattgctatggttcgaacctgagttaacccaaatatttctgccgactttataactgtacagttttgtatattaaacgtttttgaagttattaatttaaagaaagatcatttagtttattcatttagtaactgatgtataataaacgctattttcattaagagttgctttttcaactattttattcaaattgcctattgcagttgccaacaattatttattttcaataaattctgcattgtgtttaaaaggaaattctttcacagataagttggatgtcaaaaagaaaacaattcgctgtaatgtttgatgtgaagttttagtcaaggggtttatattgacgcaatattttattgttgtaaaagattaaaaaggtttaaataaaacatttttccaaa

SEQ ID NO: 100943 - DNA, 376 bp, Homo sapiens
gtaatacctgatactccagagttcatccagactagattgggtcactggcctacttatcacaatgggtggatctgaagctgactgttagattgtcaaaaacatctccatgtccattgtcgttgtcacagactcccttttcaaggatgtttgtgaacaactttagaagaaagtcatagtacctccctccatagcaaaagcaggcatgcttactgtccagaatgataataaagataatgtctttctttggaaccaagggcaggcttgtttactgcccattataaaaaatatttgatgtccctacattcagggtcgtttgctgcaatacaatcaattgcatgtacaggtgtcatgtcaccttgagggaactggggatcag

SEQ ID NO: 100944 - DNA, 483 bp, Homo sapiens
gtggtacctactgatgccagcctggcagcaccccaggagggcagggcaagcagtcagtgccatacaagcttgctcacagaggccacctcacgggtgtccacaggcaatcctcaggcaaccctgggcagtaagggcaactattatttatgccttcaattactaattcctgattgtaagagacacatactcattatagaaaaactaggccaagcacaatggctcacgcttctaatcccagcacttgggaagccaaggcaggaggattgcttgaggccaagaatttaagaccagcctgggcaacatagcaagatcccgtctctatagaaaaactgaaaattagctgggcatggtgccatatgcctgcactcccagctactcaagaggctgagataggaggatcccttgagcccaggagttggaggctgcagtgagctgtgatcacatcattgcacttcagcctgggtgacagagcaagaccctgtc

SEQ ID NO: 100945 - DNA, 737 bp, Homo sapiens
cattttttttactgatgattttgtatttgacaaactctgctacatgaagacttcttatctagtaaggaaagtaactctcagtgagtttattattttcctttcacttgtatgtcagtgctgtatggtaggatgcattgtttttcctcagaattgtgttttctgtaatgatctctgctttcgatgatgttggtgttatgtttttcaaattagataaacacttgtattttcttctgatacttttatggaatgtattttagtttatgatatgaggtcctttttattccgtgtagtgaccaatattatgctaattatagtctttaggtttaagggacagccgagctgtgtctgcctctgccacaccgtcagtgcacacatgacaatgaggcatctgtagggagcagactctcttttgccccttagcagctggatttcgctgatgacactaagatatttgggttctctgccttatgcttcatttgagctgtggccaaaatagccatcaaggttctgctgacctgcatcagccacacaaggctagtcctcactagcatcatctaagtagaaagattagtgggacatactgccaagagacaatgtttaagcactaaatagaacacttctcttaagtcacactactgtttagtgtgaaagaattctcatggtgcttgccccctcccaaggctgactgccctgtccctttccaatcagttaaggccaaggctcagggtcagaacatg

SEQ ID NO: 100946 - DNA, 669 bp, Homo sapiens
aaataactctgtaacacacttatgcactttccctttaagaaaagattccagccctgtttttcagatggtcattcagtgatacaaacctgtaggactgagataaattgctcctggaaacattttcctcttggaaaatcacagatgagactaaatgagacattttatatatatagtagcaaacagtcttaggtacatttcattttgaaagtcccatctgtcttgtaacccaaacaggttttgacactgcagagtgattgcagtacttcaggacatgcgaaacactaggaatgttcaggacaggatgccaaagaacttcatacatttttatcatttggatatttttaaaaaagcaaaaatataattaaaactctagttgtatctcttgatctgtgtgaccactgtattttgcaacatatagcttgaataccccagccctgcatttaaatacaactgcagtttttacaacaaaagagaaccagtaagtctttttccaggattaggattttaattgatatcattatagctaaaaagtttgaacatgatgggaataatgactggtgtttttcagcaagttattattcattctacatctttctctcagctatgtgcccaagtccacagtgtctgtaatatttaaattaataatgcaaatttaactattgccattaa

SEQ ID NO: 100947 - DNA, 422 bp, Homo sapiens
gggaggatggagctgtgtcataggagaagggaggatggagctatgccagaggagaagggaggatggagctgtgtcagaggagaagggaggatggagctatgacacaggagaagggaggatggagctatgtcagaggagaagggaggatggagctgtgtcataggagaagggaggatggagctatgtcagaggagaagggaggatggagctgtgtcataggagaagggaggatggagctatgccagaggagaagggaggacgtcataggaggagggaggatggaactatgtcagaggaaaagggaggttgggactgtgctataggaaaatggagggggaactatgtcatagtacaacggaagtagatctatgttatagacacgttgccatacttaggctcagtgcagtcgctcacacctgtaa

SEQ ID NO: 100948 - DNA, 376 bp, Homo sapiens
gttaagaaataatagatttcaagggaggcagggcaacatgttgcgaagctatggtgcattgttacaaaatggcctcaagtgaatcctgcctctttgcattcacacccttccacatggactctgagggtagtcttctgagggactctgactaaagtgacattctactgatgtgcaggagttccaagtacaggcttcaagagagctcatagcttgtttttgctcttagaaaccaactgctatataaagaagtccaaactatcctgcttgaaagagagacaacatggaagacgagagaaaccatgtggaaagaggccatgtgtatgagaacaaaagctttccagctgaggcaccagacatgtgagtgaagccacagtag

SEQ ID NO: 100949 - DNA, 627 bp, Homo sapiens
tgtgtgtgtgagaactgaacagtttgaatgttgtaatgtggtgactctgaaaatcagattctccacctcctcagtgattgcttttttgaggcttgcagtcatccatttgtataatgacttttctaaaccagttttgcaaagtctgtattccttgttgtgtgtggtcactgaagtttctgtcttactatctctggacagctatgacttgatagagatttagtataatgtctggatccccatccccctcaataaagggaaaaaaacaagaaaggttgcagcctaaggggacagaaacaaaagcaagaatctgtgctgtttccccaggctactgccagaactgagcaaaatgcacaatcctaaattgttgagggcaaggttcccgctgccagccctgttactaggcagctgctctaggaggtggtcctgtgcccgcctctggggatgctgaggagtagggaatagtagctggtttgcatgctgtgctctcttctcccttcatcaactactgccctgggtgtttaatgtctgattaggttctaaggttcagaatagttgattctgatgtatttttcagcttaatggttttggtggaaggactaaccctgggagctttctactctgccattt

SEQ ID NO: 100950 - DNA, 318 bp, Homo sapiens
agattccagactggctattgtgtgacacaacatacaggatatatctgaatagtgctcagaagagtttgaaaatgcaaatgatattaaaataaagatgaaaaagagaaagctggtcagaacttgtggacataacccttctggatctgttgcctgattaaaaaatagttgatattctcgaatgaattaaaacaagatttagagactgagcatggtagctcattcttgtaatccaagcactttgggagggcaaggcaagagaattgcttgcggccaggagtttgagaccagcttggccaacagtgagaccaggttgctagg

SEQ ID NO: 100951 - DNA, 480 bp, Homo sapiens
atatgaaaatgtattgtatatgagtggagtctagagcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgccctatgagtgggaggtattgtgtctctcatatagttagaagcagaagagtctacattctgttttttaactaaggaaatattctgtgcatatttcctcttagcacattagatatgtatcattcttctttaaggctgtgtaatagttttttcatatagtgttaatcctctaaatcttctaaatattttattcatggcttgctttttattagcttaataattattctttcttttaattttttttccagttttgccatggtcaacatttgt

SEQ ID NO: 100952 - DNA, 787 bp, Homo sapiens
gttatttattatcagaagttcctgttttggcattttggaaatcatcttgactagtctggcaagagttcaaaatgctttgtgttgcatatggatcatctacactactcggaataattagtacaaaagacacaaaagttgtcttgtcaaaattagtgacaggacagcagtctcctccaaccccaactttaagtagtctactttaaaggattttaagaattgttaatgactgaacctcaaggtaatgttagtatctgagatgcaggttttgttgttagcttataaaaatttaatttacttatttgtgttcagagataacacagagccactgtttctgtattctgtgtttttaaagtttaagcaaagtgttgagaggcatttcagttcaagcatggagtgttgaaaataaattccagagcatccctggtacaaacagactgaatatgttaatggtaaccttcacttcctgtccctgctgtttctccattgtgggccactaatgcctttcctttttgtagatttcatagccattcttggcctccctgaatttctctgcttttccatgggcctttaggaagaatgagctggcccgttttcctcgttcctggacactgcctatctgggcacactgatttgtatgagtcaacctgctattcttatattttctatattccaagacaggttttacttgattgatttacaagtttttacatccacctagagagtcagaatctcctttggaaggtaactgcagtccagaacattagactctaagggcatatacttccaa

SEQ ID NO: 100953 - DNA, 800 bp, Homo sapiens
tttagtagagacggggtttcaccgtgttagccaggatggtctcgatctcctgaccttgtgatccgcccgcctcggcctcccaaagtgctgggattacaggcatgagccaccgcgcccagccccaactattatttttttaaatgatcttataaaacacaccagtatgattgatcctctgctttttaaaataattttactcatctagaaggaatctccacattgctttttaagactaagctctgctattgtgattaaaataaaattttattttctaagatggatgtatgcacatttccaaagaactggtattacataaagcgcatctgtgtggttgctcaaatcttaagtacctttacaaaaaggagaagattcattatgtaggagaggttgtactgctgagttgcctatggttctgagttaattgcacccacagtcactgcactgtgttgaaaaatcaccaatttaattagcagatttcctagacagtgactagactgaccttttatatgttaagctttgtaaacacatttaagccgtgatggaatcgaagtgctagctcagatttattgaaataaatatagctcttgctgttggcaacaggaattatgagaagcagtcttcataagaagaattacatttttatatgtctgttaagaaattaaaaaaaatttttttaaccataagatcttagtaagtgttctcgctttggcagatggattaaccttgttcttttggagccagatcaatatctagtttatctctagagcagtggacagtctaactatgttttgattatatta

SEQ ID NO: 100954 - DNA, 381 bp, Homo sapiens
tccctcctgctttcccaaataactagattctcactttcctaaatacttcagaagacacaggatgttattcatatgaagaggtgaggatgccctgtctttggccagaggttaagcgttgtataacaagtaggaggattgaaagaacatacatctctagtggggatgttcttggccctcttttaatactcttcatccagcatgctggcagtcagccttacatatctcttggcaaggaactggaagatgcttccctggagaagctggtccaagagaaacgcctacagatactaacatttgaaaatactccaatgagatggtcaggacctggccagatttacaacaacaatctgagacctaaacccacttatctcagaaactaat

SEQ ID NO: 100955 - DNA, 374 bp, Homo sapiens
aactgaagtgtagtctgacggccatgaattctcataagtccctagtcgtgtgaactttcccttattttcctcaataaatgtgtatttgtatatatgtttgtgtatgtttgcttttttcgttccctcagacaactgagaaatactttgtacttcgctatccagtatttatatgtcttacagcaccttttctccttgtatgttagttttttcttcagtatccttaattttaaagctgtacttctcttttctactcagttgtctttcctatcatttaaagccatgagattgtttgcttttccttctcagtgcatccatcccccatacaaagactcttttattttcttatttatggaagtttcttgccgtcacatttt

SEQ ID NO: 100956 - DNA, 422 bp, Homo sapiens
ttctagattatcaagcctttcttggatgctaggcttttagaataagcagtcagggttgatattctgaccactacaccatctcctcatgttctggcatatgaaatggatgtttctgatttactgggacatggaatttaaaagagctggatttcaagggttttgtgttgttttatgagtaggtagcttaaaaaattatacaggaatggcattttgcccctaccttgattctttcacttcttaacttaggatgtagttttctgaatcttgtagggggaaactattcttaaaggaaacaaattcctgagtagattagccctagtacattcatctaccacaggctagtttttatgtccaggtctaaaggttactgatcccagaggatcaaccactcattggttaatttcattgtatcccctcctttg

SEQ ID NO: 100957 - DNA, 480 bp, Homo sapiens
aatcacttttagaatctgaaaatagttgtaatgctctctctttcaagagttacatatacatagtgtttacatataatttcagagtttcccagatgtccatcaggccatttctttttttctttttttttttttttgagaaggaatctcactctgttgcccaggctggagtgccgtggctcgatcttggctcactacaacctctgcctcctggttcaagtgattctcctgcctcagcctcctgagtagctgggattacaggtgcacatcaccacacctggctaatttttgtatttttagtaaagatggggtttcaccatattggccaggctggtctcgaactcctgacctcaagtgatccgcccaccttgaccttccaatatgctgggattacaggtgtgagacactgcgccccacctcatcaggccatttctaagctccagattaagaacctttgattagagacaggaacgtgttaattgc

SEQ ID NO: 100958 - DNA, 710 bp, Homo sapiens
catacttcaatatagtgaaagatacacatgacccacagctaacatcatattgattaggaaaagctgaaagactttcctttaagaactggttcaagacaaggatgcccacttctacctaccaccccctctgttccacatagtgctggaagtcatagccggagcagtcagaacatagaaataaaaggtggccaagctcggtggctcacacctgtaatcgcagcactttgggagaccaaggtaggcggatcacttgagccaagtagttcaagaccagcctgggcaatgtggggagacccctttctccacaagaaatatagaaattagccaggtgtggtggtgtgtgcctatagtcccaggtattcaggaggctgaggcaggaggatggattgagcccaggaggtccaggctgcagtgagccatgatcacaccactacactccagcctgggtgacagagcagggaccctgtctctaagaaaaaaaatagaagaaagaaaggaaggaaggaaaggaggaagggaggaaggggcatccatatcataaagagaatgttagttgtctcccttttcaggttatgtgaccatatgtagaaaaaaaacaaagagttcaccaaaaactcataaacctgataaattcagtaaagttggagaatacaaagtttgtgtacaaaagttagtatcatttctgtacaccagtaacaaactgggtaata

SEQ ID NO: 100959 - DNA, 381 bp, Homo sapiens
aagcctgagtgcccgcttcctccaaatgaggggtggggaaggggtggagaggagggggaaatggagcccacaggactccttcctacaaccttcctagactctcctccgcttggctccgccgtcagtcccaccactcaccctccctccctgcacaggctgtgggggtgcgggcagtggggtccacttggccactcactaaccggccctcacgcactcacactcacacccacactcacacactctccctccgtagctgcgcgcacttcgcccactctccggaccctgcactagcggccccggccgggagggcacgaggactgcgcagccggacccccgcaggtccccaagccaggggtcccgtccatccgcccgcccccgcgg

SEQ ID NO: 100960 - DNA, 886 bp, Homo sapiens
agctagaaaaccggcggcttgatcggcttttaggtagccccggaaaggtcgggaggaggaggggcaaaggccgcgctcctcagctgggaaggaggtggtctcaagcagcctccagtcccgggctcaacaccgccaacccggcaagggtgaggcagcgttcagggatgcaaggggcagagcggtagcggcacctgtgcacccctcccacctctgcctcagtttaccatgtacggcctcatttctctccgggctgccctgagagaaaaatgttctccagccgagatttgcttgaattggaaattcaagtgatccatggacacatcctccttgacagcccccagaagactgtaggctggttacatccccctagttagaaaaggaaaaggattcgaggagaagggaaggatgcagctttgccttttcccagctttggggcatcaagaaactgttactgggcggagttggggccagggggccagtgggtgctctgagagtgtaaagaccaaactctggtgggacctggctccattgcggagcctcaaaagctccaacatggtggaggaagttggcagtaccttctctagatctttctttccatccttagaagagtataagcccaagccgtggagtgaacaaccccaaagctaccctacgctgaactcctctctttggtcctgccactactggtgaaaccactgaccctttctgggcctgtttccttacctgtcctgaggagatgctgacctttggctccagagagactgtgagaactcagtgagggggtcctgcactccgagggtcctgcaccctgggagcccttaggtctgtttggagagaaaacagttcctccaggcaagaggggagaagtgtccccaggaggttgggg

SEQ ID NO: 100961 - DNA, 711 bp, Homo sapiens
cgggctggcatttatttgtcgaacacatacagtgtttctatccccagagggagcccttctcatgggttgtcacgagaacccattgcggacaacctttatggttttcattcatacagatgtgggctgcagcggcagagaagccctttcagtctttcattcagcacctcctgtgtccagtgagcacctgctgtgtggcaggcactgtctgtcctagctgctgtggacggagccatgagcacctgctgtgtggcaggcactgtctgtcctaggtgctgtggacggagccatgagcacctgctgtgtggcaggcactgtctgtcctaggtgctgtggacggagccattaacaatcccaaaattcctgcccctgccgggcccctggtctgggtcgtgtgactgtccaaggtctcctgatggcgaaggagccaagctggacttctgtgccctacctgcgtgccaccgaatgccaggattcgggatcatcatcctctgcggcggctctggcctgtcttcacgtggccgtcctctgtgggtgcctccctggtgcctcgtgtgtctggctctccttgtcttacaaagacactgtcatgctggatgagggcccatcacagtacctcgttttaacttaatcacctctttaaagaccttatctccaaatacagtcacattctgaggagcaggggttaggctttcagcatatgaatttggaggg

SEQ ID NO: 100962 - DNA, 500 bp, Homo sapiens
gtatctaaacaagatccacatactacatttggttatcttgtttatatatcttaaaaatcactctattattgtagattctgagtcatttgttcagtggaatgttctgttgtctgtatttgctttcttatgttgttcaacttctctcccctatgtttaattgggggttaattaaacatggagggctgaatagatttagattctatggtctgatgaatctacttaataggttggctatatgcttcatatttcatcacatcaaaaggcactatcactaggttcaggtaatgacagcctgtctttcactggaaagtttcccatcaacctttccatgcaatggtgccaatcattgatgatttttgcctgaaataattttattattggttgtaatatagggtatttccttttcttattctatatgagcaaattgctttctgtaaaaataaataacctttggatgacaaagcctggggaaacaaaaataaaaaagattaaaaaataaa

SEQ ID NO: 100963 - DNA, 507 bp, Homo sapiens
atcttttcttgataaattcacccacactagttatcaaatccaaacatcacagaagtaagttagcatcaattatttaccaagcgagacaaaggtttgtcatttttttcctatcttttccttcagccctcttcatccccattagttttttaatacttctttaatctcagaagcagtcattcctagtttatgtcaaagtcaggactttggaatttggagcactatctttaccactttctgtaactatctccagttttaggctaaaactacagggcattactcttttttttgttttgttttttgttgttttgagacagtcttgctctgtcgcccaggctggagtgcagtggtacaatcttggctcactataaggaggtcattccatttaatatataatcacttattttatgatttgtttgacatattaaattatcaaatataagtattttcttaatatacctcttctctgattttgttgatatagacttaataataaaatcttttaaaagt

SEQ ID NO: 100964 - DNA, 795 bp, Homo sapiens
atttttttagttgcttctttttgcttcaaatttcttctattgtgcgcatttttgttcagctcaaccattgtagtgattttatttctagtcatgtattttgtagagataacattcactgaagattgcagtattacttttgtagtcattacaaatgacatatgtaatatatgtattttttaatcctgtgaaaggtaagttaaaatttcttaatttatactataaaaagtgacctgtcctcaccgttgtactgtgttgatgtagaccagaggaacactgcctgtagcatataagcattttatgtatttgactatgcttccttttttcaaaaaatttttttaatccatgttgcaacttgtgttagtctgtttttgcatctctataaaggaatacctgatattgagtaatttataaagaaaagaggtttaattggctcacaattctgcaaactgtacaggaagtgtggtgcagacatctgcttctagtaattgtctcaggaaacttctaatcatgggcagaaggtgaagggcgagtaggtgcatcacatggcaagagctgagcgagagcatgaagggggagatccagactttattattattattattgttattactattttgtagaaacggggttttgccatgttgtccaagctagtctcaatctcctgagctcaggcaagtcgcctgtctcagcctcccaaagtgctgggattacaggcgtgagccaccatgcccgtccccagactctcttaaataaccagatctcctgtgaactaactgagtgggaactcactcatca

SEQ ID NO: 100965 - DNA, 792 bp, Homo sapiens
ggaaaaaagattgagaagagattcttggaaggcttcatctctgaggttagtcatcactgtaatcctagagagcttctggtaactgattgtttctgggtaattcactgtattccataaccacttgggttttctgctgtgtgtaaagtggagacagaaggcaacttgctttcctcttgagtatttctggtaattcattgccaagccatccatggcagaaagttccctcagcagaatagatgcagccattccagagatggaatctgtcctcaacaatagcctgatcaatcttagtggataattcccttataaatagaaatgattctttatggccagcataatgcagaaattggataataaaaatgtttaaacccctttgaaggtcagggtatgatgttagggaagagtagcctctgtgctctgtctaatatactcaggttccaaaaagatgcagtagagatccacagtgtttactcctgggcagaattcttatttgaatttctgtctccattcttacttttataagctgagttggacagccaaacagggaactttaagggtaataaatattaccttttccccttaagcctgggacctggagcaagctcttagcagcctgttctctgggcctttcctcttagtacctagaagtacacagcaccccaaagcccccatgcgcctggcctgggaagctaatttttaatggaggaactctacaagtttaatgctgtgattcttaacttattttaggtcagagaatcctttgaaaatctgatgcaagtattagcttccaca

SEQ ID NO: 100966 - DNA, 858 bp, Homo sapiens
acgaagcattgccagagagctagtgtgatcctttggtagtgtcactacattcagatttctcatggtgctagaattcttgtgtgggtccttctcatctggagatgctagcacttctaatttgtgtaattatttttgtttgggtaggattttttctttttctttccttttctataatattattgttatttttttcttctttccctttccctcctccctaggggtgtggctgtagagcatgctgggtagggtcttttggctttgcttctgtagccctaatgcacttctgccagcaggttttatattgggtgtgtggtttgacctacaagccagtagatggcgccatgggtaagagctggctgttgccagtgctgctggctgtgtacttgatccttgtttattgggaggagctctctcctgccccaggcaaagggctgatttcctgagtacacattaatctgagctccctcagccctaggggtagggggattgggggcacaagatgggtggagccagatagggaagattcccccagtgttgtcctgctcccagtccaggtttgggacaatgccggcagcgtttccctgtgtctttcccccacaaagtctccaagtctctcctcaaatgagctccaaggcttgggagaaacaatctcttcctctgcccgggttgcgtggatctccagtggaaaggtgagacagagggatgctgtctgcctctctcacttactgaggcttcactcacttctatcagtcgaatgctgtcctgagggctgcttgcctgcaatgtcctccgcaagatctgggatgtccttcataattccggggaattgccatttcctttcttgaattaaagctcaca

SEQ ID NO: 100967 - DNA, 403 bp, Homo sapiens
ctctggcaccaggggtttcctgagctgaccaagccagagattgcgggcagcaagacaaaggtgagatgaaacctgcgacaagatgcaaccgtcaggaaagtgggcttgaaaactgtccccttctgggaaacctcagaatggggatccccagaatggaaactcccccctgaaaggggcacacctacctcagtggtgtaagcacattgctgcttcctgacatcttacctcttgtaaacaaacagtcttttttcccaccccatgcctttggacaaatcctcattccctgatcccaaaccctagaagccagatttggagatctagaatttagaggccaggcgcggtggctcacgcctgtaatcccagcactttgggaggccgaggcgggcagatcacgaggtcagga

SEQ ID NO: 100968 - DNA, 352 bp, Homo sapiens
ctttgctccatgtattcagccaacctgaaagactggcaggacaggagcatttgactttaggaggcacagatgtggtgtgcttgggtgtgtggtgggggtggctagttctccagcagggaggccagtctggggagtggtcttcatttgaaatagaaaagctgctgagctcttgcttgtgagggacacacatgtggtctttattgacttcctcaactggtagaggcatagatttcatcggtgactttgctaaaatcagcttctgcatccgtgagatccagggggcaagggaaaggagctattcatcttaagagggaaaccttgccagtgagcagaggtaaagggaggtcatttt

SEQ ID NO: 100969 - DNA, 417 bp, Homo sapiens
gagacttgctctgtcacccaggctggagtgcagtggcgcgatcttggttcactgcaacctccgcctcccaggtgtgagtgattctcctgcctcagcctcacgagtagctgggattgcaggcacctgccattatgcccggctaatttttgtgttttcagtagagacggggtttcaccatgttggtcaggctggtctcaaactcctaacctcaagtaatccgcctacctcagcctcccaaagtgctggaactacaggtatgagccaccgctcctggagcttatgaaggcttcttgctagaaaagtcaaatctcttcaagcttctagaatcaaattccattttcagataacacaagagaccagaggaacatgttatatgacacctggggatgtaatcagcaaaatccagactggggaact

SEQ ID NO: 100970 - DNA, 1190 bp, Homo sapiens
gcgggcttagaacgccaccgacttgaggaagcccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtctctc

SEQ ID NO: 100971 - DNA, 1231 bp, Homo sapiens
agacttctgaacacatttatttgatatgtcaagtggagagaggagtgatttagggtttctccccacttctacctgtgggggtgttcataagctcagacagacagaagagcagcttagagcccatgacccaccccctgggaaaatgagacaatctgttgtagttgttggaggaacagggtgggaataaaaagcaggaagttgagaagtgaagttgagagcagtaaagacagcagcagaactgaggctgggggttgctgcaggaacccccaagaagagtgaaaaagatatcctgaaaagtggttggggttagaagcagggtgtgaataaggagccaggcctggagaaagaagcaagacctgcagaatgggctgggatgtccacggagagagtgtgcaaaatcatgataggctgtgtttcagggcatacatggaaagcaagggattgcttctgcaggagggcaaagacatcggagactgcccataagtaagggttccctactgcttctgaacaaatgcaagagagtttgggaccctagccctgtgtgtttattgatatgctgtgcctgtaggtacacaagtaatcccatatgcatgtgaaatgaccagggcatgaatacatgtgtgtatatacccagtaaatagagtacttattctttcttgctaataagagtactgtgcttatggacacatgtttaaccatgtgtgggtgcactgtgcacccatgagcacatgcaagagatccctttgttcgtggtgtgtgtgtgagctggttctcccacctatcccattaaggtcctaatccccaccctccttggctcctctcactcctctcagcgccctggctccccaggcccacctagactctggaagccccccagcaggcggatctgctcagtctgcatggagtggcgtctcaccaatttgcgcttggtcctgggagagcctggcgccccggcataaggaggggcaggcaacgaaggactcaggcgagtcagggcaaaggtgtccaggggtgtccagctccactggctccatgcggctcagtttctgcctcagccctgaagggggaccagactcctgagcttctggtgctgtgtttcggcgagagagaggacccccgctagtcactttctccgcccatgggggcgggtcctcagggccttcggtgctgtgacgtcgggaaagacggggtcgaccggtcagggtcaggccattgaattcggcagtcaagc

SEQ ID NO: 100972 - DNA, 2362 bp, Homo sapiens
agacttctgaacacatttatttgatatgtcaagtggagagaggagtgatttagggtttctccccacttctacctgtgggggtgttcataagctcagacagacagaagagcagcttagagcccatgacccaccccctgggaaaatgagacaatctgttgtagttgttggaggaacagggtgggaataaaaagcaggaagttgagaagtgaagttgagagcagtaaagacagcagcagaactgaggctgggggttgctgcaggaacccccaagaagagtgaaaaagatatcctgaaaagtggttggggttagaagcagggtgtgaataaggagccaggcctggagaaagaagcaagacctgcagaatgggctgggatgtccacggagagagtgtgcaaaatcatgataggctgtgtttcagggcatacatggaaagcaagggattgcttctgcaggagggcaaagacatcggagactgcccataagtaagggttccctactgcttctgaacaaatgcaagagagtttgggaccctagccctgtgtgtttattgatatgctgtgcctgtaggtacacaagtaatcccatatgcatgtgaaatgaccagggcatgaatacatgtgtgtatatacccagtaaatagagtacttattctttcttgctaataagagtactgtgcttatggacacatgtttaaccatgtgtgggtgcactgtgcacccatgagcacatgcaagagatccctttgttcgtggtgtgtgtgtgagctggttctcccacctatcccattaaggtcctaatccccaccctccttggctcctctcactcctctcagcgccctggctccccaggcccacctagactctggaagccccccagcaggcggatctgctcagtctgcatggagtggcgtctcaccaatttgcgcttggtcctgggagagcctggcgccccggcataaggaggggcaggcaacgaaggcgcccgacctccgggttgtgggcgaatgtcagggatgggagggtggggactgacgttgagagggggtaggaaacccggccgcgtttgcgagatgtggtccaggagcaacgtccccgagcccctccgctccagcagccccggactccgcctccttccgcttagcggagatactgcccctggcagactctcctgggactggcgcggagagggagccgagccggctggagggagggtcaacggggaggcgctgtatcggcggcgctccagggacaggcggctggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtctctc

SEQ ID NO: 100973 - DNA, 1185 bp, Homo sapiens
gcgggcttagaacgccaccgacttgaggaagcccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagctgttatcgggtccgcgtatttagtagtagtagcgccc

SEQ ID NO: 100974 - DNA, 1122 bp, Homo sapiens
gcgggcttagaacgccaccgacttgaggaagcccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctattggcggcgtctaccccgggagctaaagatccgagtgcggaagctacagaaggaacggattacaattctgctccccaagaggccccctaagaccacagaagataaggaggaaacaatacagaaactagaggtgaggaggaagtgtgcatagagacctcctgagccctggatccattccctctctcttggcccatgtgtgcctcaatttttcccttctgtgaactgaacctgagtttctattcctattcatccccacatgagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtctctc

SEQ ID NO: 100975 - DNA, 366 bp, Homo sapiens
tactactactaaattcgcggccgcgtcgaccagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtctctc

SEQ ID NO: 100976 - DNA, 1768 bp, Homo sapiens
agacttctgaacacatttatttgatatgtcaagtggagagaggagtgatttagggtttctccccacttctacctgtgggggtgttcataagctcagacagacagaagagcagcttagagcccatgacccaccccctgggaaaatgagacaatctgttgtagttgttggaggaacagggtgggaataaaaagcaggaagttgagaagtgaagttgagagcagtaaagacagcagcagaactgaggctgggggttgctgcaggaacccccaagaagagtgaaaaagatatcctgaaaagtggttggggttagaagcagggtgtgaataaggagccaggcctggagaaagaagcaagacctgcagaatgggctgggatgtccacggagagagtgtgcaaaatcatgataggctgtgtttcagggcatacatggaaagcaagggattgcttctgcaggagggcaaagacatcggagactgcccataagtaagggttccctactgcttctgaacaaatgcaagagagtttgggaccctagccctgtgtgtttattgatatgctgtgcctgtaggtacacaagtaatcccatatgcatgtgaaatgaccagggcatgaatacatgtgtgtatatacccagtaaatagagtacttattctttcttgctaataagagtactgtgcttatggacacatgtttaaccatgtgtgggtgcactgtgcacccatgagcacatgcaagagatccctttgttcgtggtgtgtgtgtgagctggttctcccacctatcccattaaggtcctaatccccaccctccttggctcctctcactcctctcagcgccctggctccccaggcccacctagactctggaagccccccagcaggcggatctgctcagtctgcatggagtggcgtctcaccaatttgcgcttggtcctgggagagcctggcgccccggcataaggaggggcaggcaacgaaggcgcccgacctccgggttgtgggcgaatgtcagggatgggagggtggggactgacgttgagagggggtaggaaacccggccgcgtttgcgagatgtggtccaggagcaacgtccccgagcccctccgctccagcagccccggactccgcctccttccgcttagcggagatactgcccctggcagactctcctgggactggcgcggagagggagccgagccggctggagggagggtcaacggggaggcgctgtatcggcggcgctccagggacaggcggctggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagaggtcagttggaatgctagcagacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtctctc

SEQ ID NO: 100977 - DNA, 418 bp, Homo sapiens
agactctcatgtgcccctggctgactgtacatgattctgaattcctcctggaccatcataaaaccatcctcgctttggccctctctctatactcccaatgcacagggatgttttgcaggcaaagaagtgtccacctttacttctccccagctttcaaaataatatgttactccctcgattgtcatttggccctctgctcagtgggagtgttagactaaattgggaggaggggtcttcctaaatttgtactagcattttctccctgaactgaccactgcccctgcctctttagcccttggagttccgcccagtacctttgccctcaggcgaggaaggggaatatgtcctggcactgaagcaagagctacgaggagccatgaggcagctcccctacttcatccggccagctgtccccaag

SEQ ID NO: 100978 - DNA, 1512 bp, Homo sapiens
agacttctgaacacatttatttgatatgtcaagtggagagaggagtgatttagggtttctccccacttctacctgtgggggtgttcataagctcagacagacagaagagcagcttagagcccatgacccaccccctgggaaaatgagacaatctgttgtagttgttggaggaacagggtgggaataaaaagcaggaagttgagaagtgaagttgagagcagtaaagacagcagcagaactgaggctgggggttgctgcaggaacccccaagaagagtgaaaaagatatcctgaaaagtggttggggttagaagcagggtgtgaataaggagccaggcctggagaaagaagcaagacctgcagaatgggctgggatgtccacggagagagtgtgcaaaatcatgataggctgtgtttcagggcatacatggaaagcaagggattgcttctgcaggagggcaaagacatcggagactgcccataagtaagggttccctactgcttctgaacaaatgcaagagagtttgggaccctagccctgtgtgtttattgatatgctgtgcctgtaggtacacaagtaatcccatatgcatgtgaaatgaccagggcatgaatacatgtgtgtatatacccagtaaatagagtacttattctttcttgctaataagagtactgtgcttatggacacatgtttaaccatgtgtgggtgcactgtgcacccatgagcacatgcaagagatccctttgttcgtggtgtgtgtgtgagctggttctcccacctatcccattaaggtcctaatccccaccctccttggctcctctcactcctctcagcgccctggctccccaggcccacctagactctggaagccccccagcaggcggatctgctcagtctgcatggagtggcgtctcaccaatttgcgcttggtcctgggagagcctggcgccccggcataaggaggggcaggcaacgaaggcgcccgacctccgggttgtgggcgaatgtcagggatgggagggtggggactgacgttgagagggggtaggaaacccggccgcgtttgcgagatgtggtccaggagcaacgtccccgagcccctccgctccagcagccccggactccgcctccttccgcttagcggagatactgcccctggcagactctcctgggactggcgcggagagggagccgagccggctggagggagggtcaacggggaggcgctgtatcggcggcgctccagggacaggcggctggactcaggcgagtcagggcaaaggtgtccaggggtgtccagctccactggctccatgcggctcagtttctgcctcagccctgaagggggaccagactcctgagcttctggtgctgtgtttcggcgagagagaggacccccgctagtcactttctccgcccatgggggcgggtcctcagggccttcggtgctgtgacgtcgggaaagacggggtcgaccggtcagggtcaggccattgaattcggcagtcaagc

SEQ ID NO: 100979 - DNA, 1127 bp, Homo sapiens
tatcaagtgcggcggctgattcggccgaggcttgggacccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtctctc

SEQ ID NO: 100980 - DNA, 418 bp, Homo sapiens
gctgggattataggcatgagccaccgtgcccagcctggctcaggttttaatggcacagagcagccaagattgatttgctgcttgtgctctgtgtgcacggtgtacgcctccgggaaaaaccaaagggcaaaaaccaagtcttcaccaaccaagctggtggaggctctgctccacatccttctcatccacagactcaggctgatggagactctatcacctggaacatcatcagttaccaccacaggggggaagggaacgtggaatcagatgagtctgatgtcaaatcctgactttgctgtttaaagcaagggacatgcctgacctgctgggtccatagttactgcttagctccgagagtattgattttccccctgtccaatgtcttcaaccctattcattgtgtattcaaccaggattt

SEQ ID NO: 100981 - DNA, 602 bp, Homo sapiens
gctcggtaccctcataggttcgcagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgcctgcgaacctatgagagatcctctagatcg

SEQ ID NO: 100982 - DNA, 2408 bp, Homo sapiens
  misc_feature (17)..(17): n is a, c, g, or t
  misc_feature (22)..(22): n is a, c, g, or t
  misc_feature (25)..(25): n is a, c, g, or t
  misc_feature (34)..(35): n is a, c, g, or t
  misc_feature (37)..(37): n is a, c, g, or t
  misc_feature (43)..(43): n is a, c, g, or t
  misc_feature (82)..(82): n is a, c, g, or t
  misc_feature (86)..(86): n is a, c, g, or t
  misc_feature (91)..(91): n is a, c, g, or t
  misc_feature (116)..(116): n is a, c, g, or t
tggttgggctccctaanggccnaantccccccgnncntggtancccttgaggatgtagcctgtgtccttcatcccggaaggnagtnggaancgtttgggaccctgcctcagagggnccctcctatagagatgtgatgcctggagaattacgggaatgtgttcctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaa

SEQ ID NO: 100983 - DNA, 1878 bp, Homo sapiens
aagacagctcgtaccggtcgactctaagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaa

SEQ ID NO: 100984 - DNA, 2238 bp, Homo sapiens
  misc_feature (17)..(17): n is a, c, g, or t
  misc_feature (22)..(22): n is a, c, g, or t
  misc_feature (25)..(25): n is a, c, g, or t
  misc_feature (34)..(35): n is a, c, g, or t
  misc_feature (37)..(37): n is a, c, g, or t
  misc_feature (43)..(43): n is a, c, g, or t
  misc_feature (82)..(82): n is a, c, g, or t
  misc_feature (86)..(86): n is a, c, g, or t
  misc_feature (91)..(91): n is a, c, g, or t
  misc_feature (116)..(116): n is a, c, g, or t
tggttgggctccctaanggccnaantccccccgnncntggtancccttgaggatgtagcctgtgtccttcatcccggaaggnagtnggaancgtttgggaccctgcctcagagggnccctcctatagagatgtgatgcctggagaattacgggaatgtgttcctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaa

SEQ ID NO: 100985 - DNA, 2994 bp, Homo sapiens
  misc_feature (17)..(17): n is a, c, g, or t
  misc_feature (22)..(22): n is a, c, g, or t
  misc_feature (25)..(25): n is a, c, g, or t
  misc_feature (34)..(35): n is a, c, g, or t
  misc_feature (37)..(37): n is a, c, g, or t
  misc_feature (43)..(43): n is a, c, g, or t
  misc_feature (82)..(82): n is a, c, g, or t
  misc_feature (86)..(86): n is a, c, g, or t
  misc_feature (91)..(91): n is a, c, g, or t
  misc_feature (116)..(116): n is a, c, g, or t
  misc_feature (2441)..(2441): n is a, c, g, or t
tggttgggctccctaanggccnaantccccccgnncntggtancccttgaggatgtagcctgtgtccttcatcccggaaggnagtnggaancgtttgggaccctgcctcagagggnccctcctatagagatgtgatgcctggagaattacgggaatgtgttcctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaaaaaaaaaaaaaaaaaaaaaaaaaaaaaaaaaanaaaaaaaaaaaaaaaaaaaaaaaaaaaaaaaaaaaaaaaaaaaaaggggggggggcctaaaccccctcccgggggggcagcgccaacaattatagccagccaccgcccccgcttctttttttgaaaaaaagagggcgggcccccactaataggcgagccgcgcgtactattattattacacgcaagcacgcgagcgcgcccgcggctggtttaaacaaacacgacgtagtcggagagaaaagacaacacctcgggctacgtggaggagaatcttattgtgagagaagagacagcccgcccacccattaatccgggggcggggaggagcagaaactatatgtggagcgagacacaaccactctccccacgagagagataatttatattaccgcgccgccacgcgaggcaggaacatatattaaaaattggagaagatggttcaattacgtttgtgtgtaaacaccaccacgcccggttattattctcgcgcgtggcagaagaaatttttggccacagaggaagttatttttagacaaaattatttcccccgggg

SEQ ID NO: 100986 - DNA, 666 bp, Homo sapiens
ctcgtgccgaattcggcacgagattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaa

SEQ ID NO: 100987 - DNA, 222 bp, Homo sapiens
cacaggtgtggggttgctgacaatgtcttgcactgtggcccaagatacatcagttatccctcatgcacaggggatctcagtgaagctccagggatgtgaggtaccggagttcttgggccccagggcaggatgcagcccgctgggggttggactctgaaaatggtgccttgctgtagctacttaggaattaggaggtgtgtgggacccattgtgaactcctct

SEQ ID NO: 100988 - DNA, 448 bp, Homo sapiens
tttccagttttggcgagtagtactgctgtctgcctaactactcaagatacactatctgtaaactattcttggttattcctttccttcatgcctcttatgcaatagctattccccttggttttactatctaaactagtccttttctcgccattcatttctgttatcctactgtcttctaggccactaccttttatttggacaactgctataatctctcagctttttttctttcctctcttacccttctcaggtttattttttataaaaaatgaatggtctttaacagtgctattatggatctcctctgtttaaattctcccattgtcgcctgttaaaagaattcatactgcttaccaggccctacaagcctctcagtgatgtagcttctgcttaaatttccaaactctaattgctactctcagcatagctcccttgatcctttaacaaa

SEQ ID NO: 100989 - DNA, 1037 bp, Homo sapiens
gtgtgagccaccgtgtccagcctaattgctgaattatttctaagagagaatacaaattaagtatttttaaaaaggataagtgatccttgctttgaaagcaatggaaccactagaaggttttaaacagggaagacaatcaagtgtgtgctttaaagtaataccagaagcaccctggattctagtgaagtgatggaggtggtaagagtagatggagacgactagtagattgctacgaagtagtctgattagtgatttgggctgggttgggttgggttgggggagcaatatggaagtggagatgaagaagagttaatggaattgagtatttaggcattggaagtgacacaactaggtgatagattgatgtctgggtgaaaaggaggtaggagagagcatttttaaggcagactcctaggtttctgccttgagcacaactgaatagatggaaatgtggagatgacacgtaatgtggtgtagagatattgtatgctgagtttgagatgcttttgaaacagctagtcaaagatgctgcaaaggaaatcatgcaaatctgggcatgagaataggaacccagtaaatgagttgaccccactttagggggaatctaggacctagtgtaacctgtggtacatagtacacaattaattcttgtgtaattatttatcacagaaaatcaactcatattttgtatttaattatctttaatgtaggaattagtggtttccttttaatattatgaaagtgacatggcccggcgtgggggctcacacctgtaatcccagcactttgggaggctgaggtgggcggatcacgaggtcaggatatcaagaccatcctggcgaacacggtgaaaccccatctctactaaaagtacaaaaaaattagccgggcgtggtggcgggcgcctgtagtcccagctacttgggaggctgaggcaggagaatggcatgaacccgggaggcagagcttgcagtgagccgagattgcgccactgcactccaacctgggtgacagagagagactccgtcttaaaaaaa

SEQ ID NO: 100990 - DNA, 327 bp, Homo sapiens
gccattgcactccagcctgggcaattgagccagattctgtctcaaataaataaataaatgtggagaaaaaagtagaaggatgtatgataagaggcactgaagacccaactgctttgaaccattttatattaaaagtagtaacaataggcaaggtgcagtggctcatgcctgtgatttcagcactgtgagaggctgagttgggcaggctgcttgagcccaggagtttgagaccagccaatgcaacatggcaaaaccccatctctagtacaaaaattagatgggagtggtggagtgcacctgtagtcccagtcactcaggaggctaagg

SEQ ID NO: 100991 - DNA, 308 bp, Homo sapiens
actttctggtgttacatggaacctactctatcacttgtcaagcatgtactaccactagattccttgattaggtcaacgtcagacatgaattttattaactcatatagtgaaatttggtttccaggaggcttttcctagatgcgtgatccaagacaagttatttaacctctgaaacttagttttctcatctgtgaattagggaaaatagagcctaatttatagtactgtgaggattagagataatatttgtaaagcacttatcattctggcatgtagtcacaactcaaatcatcacaatgataatacta

SEQ ID NO: 100992 - DNA, 347 bp, Homo sapiens
agacaagttggcccaggccctgtgctttcccttgacagggatcctgccccttctcactgaatggtcacctctgctcaggtagtttgcccctttcctgccacctctgacctccagaggctatatgctatatgtatatgctaactgctctgtacacatcaagggagtgtgcttcctatctttttttttaaaaaataggtaaaagtattcatatagttcaaaaataaaaaatatataaaaaggtttaaattgagaattatgccccacccactacagtaactaattttataaatctcttgtgtatccttatagagtttctataggagaatataaacaaatactttttcttg

SEQ ID NO: 100993 - DNA, 227 bp, Homo sapiens
ttcttttacttccccatttgccctagcccaattgccagtacaatgttaaacagaagtggggatccttgtctggtccctgatcttagagggaagacatccagtcttttaccattaagtgtgatgttggctgtgggtttttcctagatatcaggttgaattcctctttattcctagtttgtagaatgtgtatgttttaaaaaaaatcataaagggtattggctctggtc

SEQ ID NO: 100994 - DNA, 276 bp, Homo sapiens
gggcggtctcctcctcctcctccaacccatttaatcaccatggtaactgttgtgggcgctgcttccaggataaggagactgaagcatttataatagcttggaagaagggtcagtggaaaaccaacactgccctagaaagtagacatttgaaccatgccctaggaagtagacatttgaaggggcaagggttcctagggaagcaaagactacgagtcttaattcttcacaagtgaaaatgtctctaagttggaaaacagaaattggctatgctccatc

SEQ ID NO: 100995 - DNA, 290 bp, Homo sapiens
tgagaagtcccattcatcctgcagcttccaggcctgggcgtgccccccttgttctcgggacaaagctcattgttccagctggagaagagctccgctgaggattgcctgcgtttggtttccgttctctcgctttgtgtaactttccagtgccttaagagttcctctttagcccttagggtgctgacgtaagtgtggtaaaacgtagatcctaaatgggctcctcttaaatggtgattcttcttccctttagacagtcaccggcatgctgctaggggaaggatatctgcaga

SEQ ID NO: 100996 - DNA, 648 bp, Homo sapiens
tgtgacacctgggctttcactgtgcccctcccactgcctaggtcctgatgcccatcacagccctttctgctgcggcctgggaccttcccctcccggtgctgcagggagctccgcactcacgcatttaggtcactaatgtgcagcgctggggagtgccctctgagcacccgagaaattactttggttatggaactgacaattgtttccttccttctactccttccttctgtttggctgacatttccctctcaaaccctctgacacagggttccatcaggagcaccgcacccctccacaaccctctgccacggaaggtgtgcgaatgccccatctcctcctcacaaccctgtggacccatggttaggccgtttctttaagtgaagaaactaagtctcataaaggctcggtcttgctggggtctcacagtcctcgcaggagctaggatctggactagggtccttgagctagtcgctcaccctctctgagcctcactttcctcccaggtaaaacgcatgtcacaatacaatggggaccaaatccttaggcgggacacaaagggacaggggcctgggaggccttttgagaagctctgagcagagctaggcgtgccccgatccggcttgaggagcccagctcctgttcctcccc

SEQ ID NO: 100997 - DNA, 131 bp, Homo sapiens
gtattggcagcaacatctaaaccacggtgatttcacatggacaagacagaaacacagtggttatgagtgcggttttttcatggggtcaagctgcttgggcttgaaactttactcccaacgaagttatttga

SEQ ID NO: 100998 - DNA, 108 bp, Homo sapiens
ggaacaaggacatatgaatggagtttctgcctcaaggagttttaaagttcagaataagaagtatgcttaataggccgggcacggtggctcacgcctgtaatcccagca

SEQ ID NO: 100999 - DNA, 561 bp, Homo sapiens
  misc_feature (50)..(50): n is a, c, g, or t
ggggccagcagcaggcctgcctttcggatagcaaataatagaaagaaatnccataattatgtcatataaaagatgcggccagaacactgcacgtggcacggcctgtgatccaaaatgcgtgcaggcatcgtcgttaacttttcttcagtcctctgaggaagtagaataccatttcgatttgttttaaactgtgagctcgtctctcttcaggaaggaaattgatcaaagaagcaaacactcctggatattttgtctgcttgattttcagcaatttactcctaattaattattctgactaggaaaaaaatggtacctctccaggatgccagtgtttagaattgacatttcaaatagctggttggacaaattggagaaattttctgatttctgtcatttgttaaatttgcttttaagtatccctcagggagctgtattcattccaagtgcggggaattaaagttgaatctccatgcaattgaattagcctgagccacagggatgggctgcagaagcctgctgaagcttacagggagattttacttaaagctaaagcttatttca

SEQ ID NO: 101000 - DNA, 425 bp, Homo sapiens
tcacttagaaaatcttctcaattcaatgtttatataaaaactttatttagattttattataactattttactttaaaatatatttagattctaattatttgtttttaaaagctacgccctaaatttcagtggttcacagaattttttttgttatagcactgcagctataaccttacacaagtaatttaactgtaatttttgaaactaaatggtttatcaattttttatccgtaaaattggggggataataatccatatattgatcaaaattaaatgagttaatacaaaactttaaatggttcctggactcttgcaagctctccgtatacccttattttactttatctttttactgctttttctcatcacttattacagcccatggcaaatacaatgcactcaataaatattgcttggtttgaata

SEQ ID NO: 101001 - DNA, 277 bp, Homo sapiens
atctgatgggaataatattctgaggatgccaaatattttgtcctcctcaatatcctggttcctagttgtccctcagttcctaggttaacagtctcacctgtctcacctgcaggcttaatgggggtctttcgtaatgtagaaaggatacccttttctttgtaaaggctgagcctgagggcttacaattccctggagaaggagagtaagacatacgggaactccctctgggagaagagggatatgccaggccaagagagggttggaaggagaagagaga

SEQ ID NO: 101002 - DNA, 489 bp, Homo sapiens
tagagggtcttattctggctccattactaatactctgtatggcattgggaaggtggatttacttctaaaaggcctgagttttatctttaaaattgatatttgccctacgtcagaagaccgttatgcagatcaaaattaaatagtatatgtggaaactttgaagagtttgtacaaatatttgatgtacaaataagaatttgcacaacttcaaagataatggatcttccaagagttgtacaaagagagctgcacaaatataagatgtcatctgtgtggaaatgggtcagtagaggcaggtgacctggtaagggttagattggggaacaaaagaagggatagaaagagagaggatggtgccatgaaaggagaacagaatgaggagagtgagcacccccagggcagcagttgtattcagtcagttcagcaaatacatacaagcatgtcctccattccaggcactgttctcgaagcttgggatgtatccatgaa

SEQ ID NO: 101003 - DNA, 110 bp, Homo sapiens
gtcatcctaattgtatttaaaaggggaatatatgtgcttgtgtgtgtaataacctacaatgttaaatcttctgatggtgtggcatttattttaatccctttcaccatttt

SEQ ID NO: 101004 - DNA, 695 bp, Homo sapiens
gtgtgtgtgtgtgtgtgtgtgtgtgtataggtgtatgggtaggtgagggattgtattcctttattggccacagaactaattatagcaaccttaatggcttaaagcaacagagtgggagaaaatataacaagaactcagagccgtaatatataaagagctcctacaaatcaataagatcaacaaccaaataaaaatatggacaaaaactatcaataggcaagtcccaaaataaaaatagttaataaatacaggaaaatatgcaccaacctatcaacaataattacagtagctactaatatttgttaacttcattctttgtgctagatatatcttaatctttatgacaacactgtaaggtaggtactattattgtacccatcttaaagacagaaaaactgaagcacagagcagttatttacccaaggtttaataactagtaacctgtgaactgtatcactcaatgaaatataaacttaaaacaataacattattttttacatatcagaatggtaaaaacgtttaaacatgatccccaggattcaaatgggcccttacacattcctggtaggaggtatgttgatttaacagttaaaatacacagactctttgagaaattcttctcagaacctcttcgcctgagacacatttgcacaaagacgcacatacaaggatgttcccgtatcgttgtaataata

SEQ ID NO: 101005 - DNA, 290 bp, Homo sapiens
aggtgatgaggacgtcactagcactagtgggtagaggcaagaatgctgctaaacatcctacaatgcacaggacggccccacaataaagaataattcagcccaaaataacacagccaaggctgagaatgggatccatctactggttctttaagctcaacagcacccgggcgatgaggcttcacttactcaagccaaccctcccaccaggaaaagccctcctagacacctggccatctagttccccgcagaagactcctttcttttctttttcttttttttttttttttgag

SEQ ID NO: 101006 - DNA, 246 bp, Homo sapiens
cattggtgtgttggaggggtagctgggaagtgagcagtgatggagcagaatgagcagaaggagggcatgagtccagaggggtcacaggccctgggagcatcctggggacatggattttattctgaagctgttggagagctttgagatgaaggagagtcatgattctatgcattaaggacaattctagttactgtgaggaaaacagggtttagggagacaagagtggaagctgagagactggttagg

SEQ ID NO: 101007 - DNA, 380 bp, Homo sapiens
tcctatcgagatgtacattcaaggtacatcagaactctcatttcttccccttcctttcctaaaccttctctcttcctttccccctttgccattcacctttactatcacctcccacctccattatcacctccccattgccacacaacctctccctgtagagaggcaggaggtccttcgaagctttgccccatgcgtcagatggcacctgaggcatataacctagggtgggctgcctttcaggatccgtcatcaaagggagtcaaacatagtcaagataccatctaccctgtacagctttcttgagacttgggggcctgggtcaaagagatttgtctgtcccttgctgcccatctttaagtaataaaccgacttcacataac

SEQ ID NO: 101008 - DNA, 905 bp, Homo sapiens
cctcctgagtaactgggactacaggcgcgtgccaccatgcccggctactttttgtattttttagtagagatggggtttcattatgttggccaggctggtcttgaactcctggcctcgtgatctgcccgcctcagcctcacaaagtgctgggattatacgtgtgagccaccgcgcctggcctatcgggggagttttcaataggccctaagggagtcaagtctgggtttctgagacaaagaaaaggttggaggggtcctggtgttcctggcctagatcaggcttgggctgcagccatgaaggtgctgtgatcaggggcagtggaggctgctggccccaaagggacacactctactgggcgtggttggggtttggtgacacaggcattgagaagtgacagcagatagtgcaaagtgtgcatgggtataacttctggagaagttcaggtaacatctatgcgaaggcacagattcttggtgttaacgagcatgcatattggcctgccatgtgattatatttgtatcatcaactcgcactcctggagttgggaatcatgtctttttacttaacacaggtaaggagccctgctcagggtgggaaacacagataatacttaacacgttttgggaaggagtaaagaagtgaaggccaggcgtggtagctcacgcctgtaatcccagcactttgggaggcagaggtgagcggatcacctgaggtccggagttcgagcccagcctgaccaacatggagaaaccccgtctctactaaaaatacaaaattagcagggcgtggtggtgcatgcttgtaatcccagctactcaggaggctgaggcaggagaatcgcttgaacctgggaggtggagattgcagtgagccgagattgtgccattgtctgggcaacaagagca

SEQ ID NO: 101009 - DNA, 295 bp, Homo sapiens
tcaaagatgggtggataaacaatgtgttccatccatatgatggaatattactcagccataaaaaggaagcaagcactggtccacactgcagtagggatgagccttgagtacgtgatgctgagtaagagaagccagacccaaaaggccacatagtgtgaattgcattgatatgaaatgcccagaacaggcaaatccataaagatggaagctgaaggaggacaaatggggagtggttgctaatgggtacaaatttttgggggaatcaaacatttgagagctagatagaggtgatggt

SEQ ID NO: 101010 - DNA, 373 bp, Homo sapiens
ggtctggggagctggaggggctctagtgagggttctgggagggtctggggttagtgtgggggggagcacaggatatacaggtgctaggaaagagcatggagtgacctgcagtgtgggagtcaggctgggtgtgcaggtggaggaacctggggtgttaggatctcagagtgtcaggtgctggtggaggtcctgggtagtatagaggggtaagggtgttaggatagaaactgggaaaaggtctgtgtcagaccaggtacaggagaagcttggtgagatatgggttcaggatcctggggtctggcatatctggctgaatatctgaagccagggccagcccaggtgggcccaggggaaacaaggccctaacttgcac

SEQ ID NO: 101011 - DNA, 327 bp, Homo sapiens
agagtaatttttccagaattttcctaggtgaagagagagcgtagcatctggagcttacgttgccagagtttgaattgagggcaaatcatttttctttttggtgcttcagaattctcagtgggaatgaacatgttagtaccaattttataaggttgatgtagagttaagtgactgagtacatgtaaagctcttgaaacagtttctgggtaaataatgttagctgctattagtttatacgatcattaatgttgtaatacacatctgaacacacctaccaaaagttcttcatttctgtggtaacctaccaaataaaatttaaactgctta

SEQ ID NO: 101012 - DNA, 177 bp, Homo sapiens
aacttcctcacagaatcaccccaaagacaaagcaactttattctttttgttttgtttttgttttttaacccaacagggtttactgtttcccagtaagtgcagtggcaagatcatggctcactgcagactagactcagatgatcttcccacctcagcctcccgagtagcagctgagac

SEQ ID NO: 101013 - DNA, 266 bp, Homo sapiens
tgcttcatcagaggcgctactgtgtgaggaggaaccttcccatgcacagaaggccacatgcatgttcacagctcaacacccagtcacatcgcagcacacacacccacagtcacacagagccacgccaatcactgagtcacacaggcctgctcactgtgcatataaagatgctcatgcactggtatggctgtgttcacactcacacatcacagtcatgaagacaaagcacaatcacccccttacattcactcacacactcccccatc

SEQ ID NO: 101014 - DNA, 283 bp, Homo sapiens
agaggacctgtgtgtccacaggttggctttgacatgacatgtcatgacacgagatgacacaaagcagcagctgagtgcccactgtgcagtagtgaatgtcctgtcaacagagggcgtttactgaagatttgaggatggaggaggagctgaggcttgcatcataggaaggcaacagcttcagaacctgactctattctcagagtaccctcctacttgcctgcaccctcccaggggaccttccctgggggtcactatactggtccagcctctgtccatcatgcta

SEQ ID NO: 101015 - DNA, 435 bp, Homo sapiens
agggtggagcccagataggggagtgacgctgaagtgaggggagagtgggcagtcctgggtgtcgtggggtggggacttggttactagggtgaccaactgccccactttgtcccggacagaggggtttcccaggatgcaggactttcagtgctaaaaccagaacagttggtcaccctatctgtcaccaaacacctcggccgccgccagcctcgagagggcagggatgtttgcctgtcttgttccttgcggtattttcagcacctggaacagggcctggccctcagcgggcgctcggcaaaggtctgtggcatgaatgaaggcaccaggcactggctggcctcatcctaccccaggggtaggggcaggatggagtggcagaagcccactgtctccttctgtggtagggaaaggggttcatggcgggcgcagtggctc

SEQ ID NO: 101016 - DNA, 900 bp, Homo sapiens
cccagaggctgccaaattgtcatctgagccggaccgggtttcggcggccgcgctttatagtcgctggagcctggtgacctattccagggctacaagactgcctcggcaaacagcccaaggatgttcggttatctcgccttgagggttcgcgcgtcacgtgccccccccgtcccccgcttgtttttcagtttaaaagtggggcccgtgtctgcaggactctaggagctgcgggcccacccattcactgatgttaccctctcctgtcatttctcctttgtgaagggcactgaaaatcttgagttttcttgggaaagagaagacatcaaacaggcatatgaggtagaggataataaagaatattacctccttttcaagtaccttgatttttttgaagttttctcgaagttggtttaccagtttcacaataacacagagcaactagaagatcaaaattccttgtatgagggaagagtatctgtggaccaggctgaaatttctgaggggactctatcacttttactaagaaatgtggatttcatggatgaagctatctacaagtgctcagccatcacaccagatggaagaggtgaaagtacaattaagctaatagtagaagactctgaaatgccccaggtgcaatttgacaggattgatgatgaggatgtggccacatgcatctcaaaggactagtacctcacgcccattgtgacatggctggaccggacagagagggacctgagcaaccacagcatcgtggaaatcctggaggagcagatgaatggcttctacagggtgttctccatcctgaaataccctgtcaagttaaatgagaaatatctctgccacataacagagacagatgtgaacaaccagctcttcagaatcatccacaagtatcca

SEQ ID NO: 101017 - DNA, 335 bp, Homo sapiens
ggaactcagaggccggtgctggcgcgggtcctccgtatgctgaatgccagtcccctgggcccatttttctttctctatactttgtctctgtgtcttttcttttccaagtctctcgttccgcctaacaagaaacacccacaagtgtggaggggcaacccatcccttcattatgtgagacactggaaacaagttatattttcctaattccataaatgtctgtcagaagagagacttttctgctgagagttggggcaatgctgtgggtgggcacggtggtgctaggtgtatagataaaatgtccactaatgcaggatagtttatgtgtaatgtggagg

SEQ ID NO: 101018 - DNA, 246 bp, Homo sapiens
ttatctgattaaactgtagagtttataattatataaattttttttagcacatagaacagtcattctctatagcaaaagtactagcttttgtgccctttgcattggattgagttatagagctaaaccacagcaaactcatttgttccactcttaggttgcaagtatcacttaactgtgcttacttatctcatcttcaatatttacaaattttaactcacatttgtttcagtaaagcaacccaaagta

SEQ ID NO: 101019 - DNA, 304 bp, Homo sapiens
agtaatcaaaagcactagtttttaatttaaaggttgtttaaagcatacagaatatccatttcatacaactgtattagtttatcagtgagtaacaaggccagagataaatacatttaatccagacaatgcaatgccaacatttcatcaggacaattaactattggagttttaatctccactgtgtcctctaatccatcctgttaagaattgctaaataacaacaacaacaaaagggtcagaaaaaaaaaagaaggcaaggaggtataaaagtacagatgatacaaaggacagagattatgccata

SEQ ID NO: 101020 - DNA, 653 bp, Homo sapiens
caaaatttttagaggctgaatgccagctgttggcttaatccatatgttttcatgaaaccattgtgttcatctgttttctcccgggtgaagggttagttgttggattcagctttatatatttggaaataagaaatcaagtgagggactgtaggaaaacgtagagcagctcctggttttgcgaggttgttagaggccagccggcacagaaatgttcgtattcttcccaggagctaagatattcatcatgagctctttgagccaggtttccatcatctgtgaaatacagaaatgatgcttactgtgttctagctccccttaaggattaaaccatttaacagatctcactgatgcagaaatttcttcttcacattttaatatctctgaaatcggaatatacttttcattgaataatgtttgaaaattgttggatttttttcccccatatttgaacatcactgagattgggctgagtcttaaaatcattggtgtctgacttcatgaaataaggtaattatgggagccgcattggtcttaggtgtatactaaatgttagtaacctttttccgtaataactaagaaaaaaatgttgatacaaacatcactatgtgaaagaaaggctcacaggtgtgagaagaacagggaggctgggttct

SEQ ID NO: 101021 - DNA, 984 bp, Homo sapiens
ggggaggagaggaggaggtatttggtgacactcgccatcaggactttgcagctctcttgccagatagcagctgaattgaagagctaaaatacaaacaagagagcaataacgatctttgcgtggataatagctaaacctgaatagaagcttccagggccctaatacacagccaaggaaagctaacagtcatgattcaataaaggtgccttgtaaggcatgtgccagacagaaaggagacaccatatctgtgtaatctacagacactgctttaaacatcacataattaagtccttcccatggtggtggctacttgaagctttatcattagcttgtaagatttcatctctgggtttcaccgatggttctgagaatgaacattttcaaaccagaggcacctgctaatccaggagacatactcaccacgcctattctcgtcctccagtgaaagaagctctatgttaaatgactgaagggaaacagaagggaatatgtaacaaaatatatacaggagcagccccggggtggctttccatgctgagtgttctattacattaatcctggcacacaaaaaatgcgacagccacatggatatcaatatgcctgcattgtttgtcttccatcggccctctctgtacacaggcatgcattccctcgagcaagatcagcgtgagaagtgattccttcacctggcacgaactgaatagcaaaagaaaaccgaaggcagaattccgggagtgtccaaggtggtgttttgtcgtaaaagcatgttgtgccccaaccccggagattttgaggttggtgtgaacgccgaacctacgggcttattccggaacaatagctgctgtgcggcattttgaatgaacacggtcccccttaaatattcggggggggggcgaaacaaagatttggctctagacttcggcaaaagacgctcgcttgcgagaaagcacatgacagcgacacattttgtgaggacaacaccag

SEQ ID NO: 101022 - DNA, 255 bp, Homo sapiens
gtcagggaaaagcaaaaccatgatgagatactcactagaatggctaaaattaaaaataccgacaatagccagttcagccgaggataccaggaattctggcgttcaagggtgctggtaggaacgtgaaatgactgccactctgtaaaacagtttggcaatttctcatgaaattaaacacatactaaccatatgacctagtgacccattcctaggtctttagccaagtgtagtaggctaaaaaatgggcctccaaaa

SEQ ID NO: 101023 - DNA, 448 bp, Homo sapiens
gggcataccaggagtggccagaatgcctgggcttaatgaaattcttagtgatccagaggttcttacagccatgcaggatccagaagttatggtggccttccaggatgtggctcagaacccagcaaatatatcaaaataccagagcaacccaaaggttatgaatcttatcagtaaattgtgagccaaatttggaggtcaagcataatgcccttctgataaataaagcccttgctgaaggaaaagcaaccaagatcaccttacagatgtcacaataatacaaaccagtgtacctctgaccttctcatcaaaagatctggggtgctttgaagataattcctacccctctccctcaaatgcagctgaaacattttacagtggtttgccattagggtattcattcagataatgttttcctactaggaattacaaacttcaaacaccttttaaa

SEQ ID NO: 101024 - DNA, 301 bp, Homo sapiens
agtaccgtaaccatacaaaaacacccttatcatttagggcatagggctagtacaagaccttagtttctaggagctgaccaagggccagtctaacccagctgaccaagcaggcctgtctgagaatgtgcatcatttgagcaactcaggcctgctgggttaactgcttacaccattttccttcccctcctctcccttgccttcgccactcttaacctggaaaaagcactaatttgtcctccatatctgtagttttgtcatttggaaaggttgtagaaatcctagagtatgtgaccttttaaga

SEQ ID NO: 101025 - DNA, 393 bp, Homo sapiens
ttcccaaagtggttgtaacattttacactcctactaacagtgcatgggaagccagtttctctatatcctctccaacatttggtgctgtcaatcttttaaaattttagccatttttgtggttgtatagtgttatctcattgcagttttaatttgccgatccctgaatgtgtgtaggtgtgtatatgtattatataatatatatattattctttcacttattttgaagtaatttcaaagtttccagaataatatcaagaactcctgtactcccttcgccagattctccaattgtaacgttttattgcatatgctccattgcccattctctctctacttatagctgcattagtgtttttctgaacctttagagatgaaggtgaaaaaagatgcgat

SEQ ID NO: 101026 - DNA, 995 bp, Homo sapiens
  misc_feature (371)..(371): n is a, c, g, or t
  misc_feature (752)..(752): n is a, c, g, or t
  misc_feature (755)..(755): n is a, c, g, or t
  misc_feature (757)..(757): n is a, c, g, or t
  misc_feature (762)..(762): n is a, c, g, or t
  misc_feature (773)..(773): n is a, c, g, or t
  misc_feature (778)..(778): n is a, c, g, or t
  misc_feature (794)..(796): n is a, c, g, or t
  misc_feature (799)..(799): n is a, c, g, or t
  misc_feature (809)..(809): n is a, c, g, or t
  misc_feature (818)..(818): n is a, c, g, or t
  misc_feature (820)..(820): n is a, c, g, or t
  misc_feature (952)..(952): n is a, c, g, or t
agcggacggtgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgagattgcctgaggttgactgtacatgcaaatattgagctttcctcctggcctccgtgataaacagaagtttgatatgttaggcgagatggaaagaaagtatcaaggagtgagctgaagccactgcccttgagaaccctctcgaggagtctggcctcatgaagatgccagaataaatggcagtaagaagaaaangagcaaagataagaagagaaaaagagaagatgaagaaacccagcttgatatgtgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaatacaatgtacattaattaacgtggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaatanctnantatanattcagatganctgtngtggcgtcagatgcannnggnccagagaacnagggaaccngncttcacaactgaggcatccagtagaagatgaaagctcagataagggcacatatgaggagtcggaactgattggcacagacaaggatccggcacacaccaagaggacagggtgaatagaagagaataaatcgnagaaggaaagacgaatgagcggaaacgagacaggcagcacgat

SEQ ID NO: 101027 - DNA, 337 bp, Homo sapiens
tatgtgacctgtattaactgagaccctttagtttgtaaatagctgatttatgccaattggggaaattaactgcttctcttaactagaaggtctagcttccattaacatagactaagaggttccaacaatgtctgcaaatcttggtctctctctgtcccttgatggttttctctgagccagtgttgttttaagtaggctctccctgggggtggtaaggagcttctggcatcctcaagttcaaatcctcacagttcagcaatcccaggacaaagagaatttctctttcttggggctacagcaaaagattcctcaagggctctcagtcgagtcatttggg

SEQ ID NO: 101028 - DNA, 133 bp, Homo sapiens
ggtcatcaccttcaggaccacaatgcctggtagggcaaggactcgcgcccgaggcagagcccgccgcagggagagctaccaacaagaggcacctgggggacccagagcacctggatcagctacagtgagccct

SEQ ID NO: 101029 - DNA, 266 bp, Homo sapiens
gccaatgtctcacgaacacttaatccatttgctctgcttctgtctggtaactatattcaaggctgccatatactgttccgcaggtcgtgcactgcacaaaggcacgatctctgagagcattcacatcctacacataatggtgtatttattacaatagtttagttttccagcagatggcagtaaagcatccagcatgttataacttccctacaggaagtgttttaggggacgcctttttttctaatttgctcaaaggtgccccaggg

SEQ ID NO: 101030 - DNA, 462 bp, Homo sapiens
acttctgtatgcgtcgaccttctgctctgggtcgaccttctgctctgggtcgaccttctgttctgggtcgaccttctgctctgggtcgaccttctgctccgggtcgaccttctgctctgggtcgaccttctgctctgggtcgacctatctgtctgagtagaccttctgcactgggccacatccatcttcttcattgtcagaatctgagttttctgtcttgaagaacagctggaaagttgtctggctgttatgacacagtattgaaataccagactgagtttcagttgtttctagttgtgttcactttgtgctttctctgaatgggaatatcttctttcagcaaagttcttcattgaccaggaaaccaaagattgcttcttttccaagtttgttttgtttttaatcttttaccaatgtgcagtatatcttaagaagggaagagtgctcttgggagtagaagaa

SEQ ID NO: 101031 - DNA, 411 bp, Homo sapiens
tctgtacttcacctatagtgcctagcaaattgttatcactcataagcctgtaatcttcatcactcaggttatttgcaagtagaaagcttctggaaccatttgtccatccgacttctgcactgggccacatccatcttcttcattgtcagaatctgagttttctgtcttgaagaacagctggaaagttgtctggctgttatgacacagtattgaaataccagactgagtttcagttgtttctagttgtgttcactttgtgctttctctgaatgggaatatcttctttcagcaaagttcttcattgaccaggaaaccaaagattgcttcttttccaagtttgttttgtttttaatcttttaccaatgtgcagtatatcttaagaagggaagagtgctcttgggagtagaagaa

SEQ ID NO: 101032 - DNA, 928 bp, Homo sapiens
ggctgaacacggtgcgcttcacctcggagttcccactccactccaaggatccaacagcgcacaagctgctcttcacgggcaactacctctgcaagcttcacccccggccccgccacgccccgcagggttccctgtctggtctggatcacctcgctctccctgcgcctctctccttggcctagctagacaagtgcttctcacgatccagcgcgtttaccgctcggtttcgtcgccgctaaggggtggtggtgtctgatccgtcaggctctgcgcttctctctcggatccatcctcaatgtccaggcaggactctcacatgaagccggtgctgtctgctgttcactctaagatgtccagccactcaggacagttacgatctgtcatccagggcccaaaccgactctcctctattgctatctgaggtaggcagtctcctctgtgaggtcggtcccatccatactgcctagatccctgcgcaggaagactgagatgaggaccctaggagacagcagccagggatagcgaaggtggaggatgagtataaatagcgaccccagcgcgatcagagaagctcccttacccccaccatcgcagtgggagtgagtcttcagatctacccccaagacaacgaaatcctacccgggccattgaagggaaacctccactccaacccccagaagacgccttagatgagaaagtgaagagatattgtatgagctcattcatcaaaggccatgccatcaccagctcaggcagtgctgctagggggattcctgcctctctggagggtccagttctctctgaagaccgagaagatgcagggaggaagggtttcaaacaggaactctcaacccacgtctgccagttgtagactctgtaaacaaagttccaactcgcccgctgctgccactgccgctgctattttttg

SEQ ID NO: 101033 - DNA, 413 bp, Homo sapiens
tctcgagcctgacttaccagcctgctgggaaccctcccagaacccagcgtgtggtatgatggggcctgcctaccctccatgactgcaaccctacactaccaaagcctctgcaggctgagttgacttcctgaagttggcaggaataggggtggattatggagcaagatggagcctggccctgttgaattcagtgaagcaggctagggcagctcaaggcagagaagaagcttggagagccctggctcccaacttcaccttcaaaccctgggtcatcccctgtggcagagactacttgttgcctcttaatattcattctcctattcttacacagtaattgaatttgtagctggctccctagctaaagattacatttctcagactcccttgcagctacatgtggtcacatgactgac

SEQ ID NO: 101034 - DNA, 501 bp, Homo sapiens
taatgaaccctcctttgaatgttccttgtaaatactcagtgttcacaagagaatgctctctgaaaaacaaaactacagaacgcaagaggtctgatctctgttttagcagagataatatggtagtcatactgaaggggcccctccacatacgcagatggaaggcggaacgtgacgtagcaggaggatgtgaccctgacccactgttgactcctgcaaggtgattcctggtgattctttcttgtgttttaaaactgcctgattcacatcttcctctggaacccaatgtaatagagattgttgctgttgttgcttctagagagtctttgaaggaagctagacctgaacaaattctaactaaagacaaagcagttcctggtttctcccttttgaggtcttctgggagataggagcagttcttctagaggatgagagacattgaaaagatgagattatgaccagaaagcagaaagtaatcacaatacttagtaggaactttgttgg

SEQ ID NO: 101035 - DNA, 731 bp, Homo sapiens
aaattattctattctttaaaaaaaaaaaaaaaagagaaaaaaactagagacagggttttgcctggtctcaaactcctgggctcaagcaatcctcctgcctcagcctcccaaagtgctggaattacaggcataagccactgtgcccagcacaaaatgctcattattaatgcagtaatttctaatcttacatctctggaggtctagttttcagatgcctcaatagctgaatctcaaaatgaaaattaaaaagcagagaaatctcctgtaatcgtagtgctttgggaagcccaggtgggaggactgcttgaggccaggagtttgagatcagcctgggcaaatagtgagaccccatttctaccacacacacatacacacacacacacaaaaattaggtggacatggtgttatgcacctgtggtcccagctacttgggagtctgaggcaggaaaatagcgtgagcccaggagttcgaggctgcagtgagctatgaacagaccactgcactccagcccaactgacagagtgagactctgtctctgaaaaaaaaaaaaaaaaagaaagaaagaaaaagcagagaaatcattctaacaaagcacttgcacactgccctgtgggagaggaaggaaagccactgtcctggagtctaggggtgagggctgcaggtgggacttctgacagcacaggcaaggcaatggagcacagtggtctctagtctggggtgtgtgtgtaag

SEQ ID NO: 101036 - DNA, 386 bp, Homo sapiens
gaactttactgaaagaagacaacagcatcgtgtttatctgttttgttaattcttgaccttagattccagcttgattttggctgtaccttaatagcttgctgtcgtttctcatgtaaccctgcattaaacttaactcctggctgggcgccatggctcacgcctgtaatctcagcactttgggaggccaaagcagatggatcacctgagatcaggagttcgagaccagcctggccaacatggtgaaaccctgtgtctactaaaaatacaaaaaattaggcgggcatggtggcgtgtgcctgtaatcccagctacttgggaggctgaggcaggagaattgtttgaacccgggaggcagaggtttcactgagccaagattgcggctactg

SEQ ID NO: 101037 - DNA, 275 bp, Homo sapiens
tgccaaatatatatatctgaacatagtgaaaaagtaacatttaaaatcagtcaaattatttttaaaattcctttgcttaatagccattacttactcaccttttgtttttgttttttccttcaactactagagtactgtacttttgctttcattccttctatacattctgccttcatccttaaattgttcaactcgatagtgctaatattggtagataatctacgctagctgctgtttcttgtacagaagttggttgatatcgctgattcactttt

SEQ ID NO: 101038 - DNA, 860 bp, Homo sapiens
tttttttttagaagaaaggcagcttggaatctgtataaatgaaagagagagatagaatgggtaaaaatgattgatggaagaattttgacctactgggtttgaggtaggaggggaaaacagaagggtgctcttctctgaaggtgtaaagataaatttagagcggacagagcagcaaagagttgaaaagtttttgtctgttggccttcaatttatccatgaaggaaggagcaacgttatctgctacaaggacggaggtggcggggaaagtctggactggtttttaggagacaaggggtggggggtgagggaaagactatagataagaggacaaacagaaggtctgctttcgcagatctactatggtcgaaaattattttttctttcctcccctctatcccttcctaacctaagcttgtcgcaaaaaaggcttcaagctgccaaatccaaatttttccaccaatataccccgatactagttttttctccaaaaacaacgggcaactaacacgcagggcagagaaaacaaacagttgccccaggcttccttcgttcgaatagtgaagactgagctggcctcggcactgtgcagactcccaacctgtgctactgtgggttattctccttatagtgcagtcacctcctaaatgcttgctgaaaataatggaagacttcgagccagatgtttgcctcttaagtaacgtcccccaaaagatgcagcacatatttaaggcctgctgaagcaagcaacgctgacggaccaggttattgcgtttttctctcgctgcgtgtccggacgccacactatgagcattaagcgcatactgaccaatttctgttaagcaggaacgtggtgttctgat

SEQ ID NO: 101039 - DNA, 516 bp, Homo sapiens
tttttttttagaagaaaggcagcttggaatctgtataaatgaaagagagagatagaatgggtaaaaatgattgatggaagaattttgacctactgggtttgaggtaggaggggaaaacagaagggtgctcttctctgaaggtgtaaagataaatttagagcggacagagcagcaaagagttgaaaagtttttgtctgttggccttcaatttatccatgaaggaaggagcaacgttatctgctacaaggacggaggtggcggggaaagtctggactggtttttaggagacaaggggtggggggtgagggaaagactatagataagaggacaaacagaaggtctgctttcgcagatctactatggtcgaaaattattttttctttcctcccctctatcccttcctaacctaagcttgtcgcaaaaaaggcttcaagctgccaaatccaaatttttccaccaatataccccgatactagtttttgtcgagcggccgctaatttagtagtagtagtaggc

SEQ ID NO: 101040 - DNA, 574 bp, Homo sapiens
gtagagggcacagtatcccgaaccatctaacggggcccgactcaccctcaccatgcaccaggccagttatggtttctttctgtgtcttatttccccctccatcaaatgagagttattgtagaaaccttatagtgctgtgttgggattagcagtaaacagtttggcatgtggtagatgctcgggaaatggaagctgcccttttttcctaatgggaaagaagggattttgtttttgagacaattcccttcctctgctgctgcatagggacacctgggtgcctttctaaaattagaccagggcatggtggcttgctcgtaatcccagtgttttgagaggccaaggcgggaagatcacttgaggccaggagtttgagaccagcctgggcaacctagtgagactccgtctctataaaaaaataaaattagctggatgtggtagtgcacgcctgtagtcccagctattcaggaggctgagtcaggaagattgcttgagccccaggagtttgaggcaatggtgagccatgttcatgccactgcactccagcctagccaacagagcaagaccccgtctcata

SEQ ID NO: 101041 - DNA, 171 bp, Homo sapiens
gtaagtacactctaggatgttcatacaatgatgaaattacctaacaatacatttcttagaacatatccctgtcattaagcaatgcatgactatattaagaaacatgtacttacagaagtgatacgtcttaagaaaagacaataaaaatccattttaactaactttttggtc

SEQ ID NO: 101042 - DNA, 217 bp, Homo sapiens
tacttacatggtaatcagcacctgccccttccttcgcaaatacattcccacttttttaggatttattatttcacccagccgtgtgcatcatggaaagctgacctcatcccaagctccaggaaataaaaccctgatgatttgaagccattcttccttactatgattggcttaggagtgggcaggtagcccagttctgaccaacaatatgtgagtcagc

SEQ ID NO: 101043 - DNA, 136 bp, Homo sapiens
acttgaagttcctggcacggctggcaagatttggggcaggcgagtgggtgagcatgctgagcagcagcagaacagcagggggtccagctctgtccacccctaatttctcaggctgaccccaagcccccaggaccag

SEQ ID NO: 101044 - DNA, 249 bp, Homo sapiens
ttttgcaaatactgtatatgccactaaggcacggaataataagacgttagtaattcaatattcaaacagataattgtatgcccatgtctatattagcctcataaataatttcattagtagtgtgtcattggaaagaagaattgcaaacagatttttcataagagaatatggtgaagaatgaaatctctctaatgatactcatatgaaactttagtattgttgtgtaagttgggatctcagtattattca

SEQ ID NO: 101045 - DNA, 729 bp, Homo sapiens
aaattatagaggtccttctgtgagtccaaaggagaaggaagtggttggggcagccagaaaggtgcaatctgcattaatatcatattcgatgtatggattgctggggagagagtgggatatatttcttataatgttggatgtatttttcccctatcctgaggcccagaaactctgatgtctctgcagttgtctttccatgctttcctttatacccctcgcctacttctgtaatttctctctctactctccctcctccttcccaccctttttctttccatttgtgctctctccctccattccttctttttcccttttctttctttttgtgggtatctggtagctgcaacttattttctttctgcttttcttactcacttactctatttactaggtatttaacaattgtctttaaaagtaacatcctttctttcttaaaattttatccctaatggacattatttggggaaaaaacatttttatggtgcctctagataagtaattatatcatctgcacatgattcccgtattttcttacatgcccgttcctcgtaggtggaaatgggtacttcattgtactcttctctctttatttacaagagtgttttttctgtctcatccctttaaataacacattgtctctctttttgtgacattgaattaattaggtcagatgcgatttttctcatctattcatttgaagactgtttcatattgcttctagggcctatt

SEQ ID NO: 101046 - DNA, 700 bp, Homo sapiens
cactccaaccccagagtattaaaaagaaaaacaaaaaacaacaacaaaaaaatcaaacctgaactaatgaacaatctggtgttatataacttactttgagggcatgtaaagacaaatgtatctcaaaattctagtgttaaacaaacaaaaaaaccacctgtgactctggtcagcatacacaataccctaaagccacaacaaataatacaatttcaggatccagtgtttgtaaaggaccctggatcctgaaaaggagacttacttccttaaaactttctttattaaatttttaaatgtgattatatttatatagtaagcactggtatacttgtgaagtcagaggcctcaaattttaactagataccaattattcctttgttaacagttggttcttttcatataaccaatgaagtattgaaaatcaggtgttatttacagcatatgaacattactaattctaagtaaagttcagacagagtttagagaactgatcaaatactcgtaacaataaccacttccaaaataaaggcagcatttactggatgcttatgttgcaccagccactgttcctttaaccacttttcatgcattaactcaaataatgctcataatgtttaggagaaaagtattattcctattagaccaaagaattaaactcatcttggccaaagccaaagcaagaaaaccacagctagaatcc

SEQ ID NO: 101047 - DNA, 901 bp, Homo sapiens
aagccagttggaaggagcgcttcaagagcccggcttctcaggcctcacatcctgccgcagacccaccgcaggtggcactatgaaaaggatgcggcattaacagtgggcgctgcggcaggttgcaaaatccagcggttccgtcgcaggtacagactgcatggctaccacaccggctgcggaggctttgcacttgagaagtgagggcaccttcctgcatgaagtgtttgattgtttatgatcctgggaaagtcaggtttccttgccacagagctgaaatttgccacagagctgaaagcacatgatcactttggggtattaagactgcagggtgggccgttcgcaccatggctcacgcctgtaatcccagcgctttgggaggtggacgtggaaggatcgcctgaagcctggaggtcaaggctgcagtgagctataatttcaccaccgcactccagtctgggtgacagagaccctgtctcgaaaaaataaaaataaaaaaactgcaaggtgaccgcagctcactacatcctggccggggactgggctgtctggaccccccagctcctcccaaagctgggctccttcccattcatccttcacgggagccaaagagagcttttaaaactgcaaagcgcttaatgcaacgtgggctcctggaaaagaaagcagacgtttgtggagtgcagtctggagtttagttgggagtaaagaacaaatgttggcttcttagttttgacaaatgtaccacggtaacggtaagatgttagcaatgggagaaactaggggacgggtatacaggaactgtctgtactatctttgtaactttcctgaaaatctaaaattattccaaagtaaaaagtttattttgtaaaaaaaaaaaaaaccccgcaaagcaggtcacatc

SEQ ID NO: 101048 - DNA, 450 bp, Homo sapiens
aaccaatgcgtaggcatcttgcattattttcttgacagtgtaatttatattttccccagtaaagggttattttggtcaggcatatttgcaaagtgctgatattcaactttgctctggggtttttaatgttaaaaatgtgtatttattcatcaagtgtttattgagcctcttgctgtgttccaggccttgttcaaagctctgggcatctagcaatgagtaagatagtcaagatctgtgctctgtccacgttctcttggagcttacattttaagagtaagaaacaatttaacagatgataaatgcaatgaacaaaaatgtaacagaatgtaatagagatgggggtgggatgaacccactacttttgggttggtggtcatggaaggaaagcttttccaagcatttgaaccaagttgcagatgacaggacagagccaaccatgccatgatttgg

SEQ ID NO: 101049 - DNA, 399 bp, Homo sapiens
aagatgtggcaggctcaggtctgctagataaggagacttgactctggaaggaaaaagtaactaaggattgattttcaaaactgagcaaccagctgaggtttttgaggcgaacagcatgttgaaggcagctgatgaaatgtgaggtttacttactccttgtccttacagggactgcgtcatggtgactccaggcccggggactggaggggaatgtagcgtcctcgtccctccctcacctgggcgagtttccagtgcttattcactgttttccttctggccgtttattcacgaaacgtggaggagtatcatacataatacaaccctatttaccttgtcttataccccatttcctagccatagagtaactcaaggccgttcgcttgtttgaagatcctttaa

SEQ ID NO: 101050 - DNA, 278 bp, Homo sapiens
ggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgt

SEQ ID NO: 101051 - DNA, 545 bp, Homo sapiens
tgtggaatcccagagacctgggactgattctggtgccgtgtgttgccatttgtgcgactttggcaaattacccagccacccagagtatcacatttgtgactggagacgttagcggcttctgtgaaggatgaggggtcactgccagggttgcctgggtggactgttggatgagctgccggaaccagctgccctggtacttgcccggtacttgctgaaggggatgggggttctggatccaggtgcacccctctcaggatgcccctgatgggcctcgggactctcagccctcaagtatggggtcagcacgctcaggggaagctataaatcactcctcattctagccgcctggctccaggatgtttgtacaggtgcccctccctctactccccagccggctgtctgggtccactgccggcaaggtgtgccaccacgtcccatgtactcagagaccccagcggactctctgtgcagacggggcatgttagcattgcagggacgtgccctctggggtggacactgtccaccagatcggcagaggttggggg

SEQ ID NO: 101052 - DNA, 318 bp, Homo sapiens
gatttatgcatggctggagtgcatggccggagtgcatggctggagtgcaatgagcggagtgcagtggctcacacctgtaatcccagcactttggtaggctgaggcgggtggatcatgaggtcaggagatcaagaccatagtggctaacacggtgaaaccccgtctctactaaaatataaaaaattagctgggtgtggtggcacgtacctgtaatcccagctgctcaggaggctgaggcagggcaattgcctgaacccgggaggcggaggttgcagtgagccgagatcgtgccactgcactccagcttggtgacagagt

SEQ ID NO: 101053 - DNA, 403 bp, Homo sapiens
gacccttttcacttagccctcttgggtttgcaacatgctttctctctcaccttctcattgaatgagaaaaaacagcccagccattttttgcaaacagcaaagcaccagagtgatgatggctttgctcatctcacttgactttcacagtaactcagtttgatgtaggcagtccaggcattattattttcattttacagatgatgcaactgaggctcagtgtggtgaaacatttggctcatagccacacagctgataagcatcagggacttggacctaggccttcacatttcaagtcagctgtatctgtccccaagccccaccagacttcatgtgaaggtggctgcttctgggtgatggtggctggagaggcagactttgaggctgccatgctcttatttcagat

SEQ ID NO: 101054 - DNA, 231 bp, Homo sapiens
ggaggaggacgacgtccctcctgaagagaagaggctgcggctgttgctggaggggggaagcgcacagcccgaggactgcgaggacggggaggacgcgctgcggccgggcaaggaggacaccggcacccagacaggtggcgacggcagaggaggtgcctcaaactgctgcccttaaaacacgtgtaagagaatcatccaggcggcttgctcgctctgcatgcatacccttta

SEQ ID NO: 101055 - DNA, 281 bp, Homo sapiens
cacgtgactatctacattgtaatggtcaaataaggtggataatttgcccatggttgtatagctgctgagtggcagaatgaaaccccatctcccatacatcctgctgcccctgggttcaagcctggtgacaaatgtcagcgtcagtgttgagtgtgcctgggagggtgggagtgaggcttctaacctaggtgcctacctgagtcaacaaaatgcactaaaaaaagaggtaggacagtaccaagctagagaacaacaaattttcctgttttaatgtttcatgg

SEQ ID NO: 101056 - DNA, 691 bp, Homo sapiens
aacagaacgaggccggcattttctaaagcgtccttgaggagtccagttcctaaaagattatttcagagtccactgttgtgggctgacttgaatgctctcaaaattcgtaagttgaagccctgacccccaggacctcagaacgtgactgtgcttggacacagggactttccagaggtgattaaggtgaagtgaggtcactggatggccctcctcctatctgactggtgtcctgatggggacgcggacacccacacaggaacggacccggggagaacaacacatcgtctctgcgccagggagagaggcgtccggggaacccagccgtgcccacgcatttatctccgccttccggctcagaattgtgaggaaacccgcttctgttgtgcaagtcccgggtctgtggtgctcggccatggcgcccccagaactgcatccccaccttctgctctgagccacccatcccctctggaagggctgagcttctctccctttccaccttctgttctgagccacccgtcccctccagaagggctgagcttctctctctttcactgcctatgctctgggaaactttcagaatccccaggctgtttctggaatagtctgggatggtcattttcggtcctcacagaaccgggggtttggaaagtaggtgaagccatatgggttgcagagaatctggcccagcccc

SEQ ID NO: 101057 - DNA, 340 bp, Homo sapiens
gcggccgcctactactaaatactcggccgcgtggtccaaagcttgggttttaataggccacatatacatggaagtgggaaacagcctaggggcccaagcaggttggaaggccagatcagggtttgaatgtaaacccacaacccccaaaaggcaatatgcttagtggatgtggcagaaaattttctgccccagagatgatgtgaatatgcacctactttagtttcggctcgagtttggaacaaaaaaataaaaattgcctcctctgataattccttagcacaaaccaccattcacataggattgggacttgaatacacactatgctggaggtgccaaaact

SEQ ID NO: 101058 - DNA, 663 bp, Homo sapiens
gcactcgagctcggcacccatcttccctctctcacaaaggtggtattgtctacttcagtactgtttgtaacagcaaataattaagacaaatgaaaacttggaaacctaaagatatggatgatggcagaattaaaaaatacactgtgctatattcatcgaaatattatacaatagttaacatgaatgaatcaaatctaaaaatgtatcaagatgaatatacttaaaatgtggcatacagagtagagtttttctcctgcttttccaaactgcaaaagaatatgtatagcatgacacatacatggtaaaaacttttaacacaccacatgtatatacacgttgcagaagcaaaaaagaacaacccatgggcaagaatgacaaaaccaactctgggcaagttacctccgaaaaagaaaaagaaatgagagaggatggggaggaaatggtctttagttgtctctataatattttattgcttttacttttttaaagaaaaactaggctattaagagatcacagcggggtgcggtggctcatgcctgtagtcccagcactttgggaggccgaagtgggcggatcacctgaggtcaggagttcaagaccagcctgaccacggagaaaccccgtctctattaaaaatacaaaattagccgagtgtggtggcac

SEQ ID NO: 101059 - DNA, 493 bp, Homo sapiens
gtctgtaaaatcggatggactgccaatcggagaatgagagctgcccagcctggccttacattttttcaattaattcataaacagaaagggggatatgcagggagccgaaggcccatgggatgtgaccaacgcagcattccactggaggctatatgatccaacagcaaactgtttatcatgaatgcaggatgtgagaaaactgacgactgctcctgccgacagaaggtttgctggaggcaatcactccctggcgctgaggttatctactgcaacatttagcctgttgttcgaggaatgcagtcttgcaagcctgctctagactgagcagctgaccccttcttccaccccgcttctcactatctcttttgcctaataaataaggagggctgtataaagctcagggcccttgtccactaggggcaaggtaccccctgaccccttcttcaaaatataaaaggaaaaaaatatacaccactggtctcgttggcctcaa

SEQ ID NO: 101060 - DNA, 479 bp, Homo sapiens
ggccacccagagaatgaatggtgggactgagatcacacctgggcctgcctggctgccaagccttttgctattttcattattccacatttctttccaaggatacagaaagcagggataggaagtgctgtggaaacaagcaaaaagccttatccatagtcagcatccaaaaagtactataccttctctgacccctgctttatttatttgtttattttcagggatgatgtaatagccagaaaaataagtgaacagaagattccgggttctactttatgccaatttttcttaaatatctcagtcactagaaaaagatctatttgaaaatcttgctctgagcagtttctgtcttgggcccagttgtttgaggagcctgttgaatttttaaatttattagtgttcccatgcttcattcattggcatatatgtatattctctatactttataattacaagtaagctcttgataataaaaagtaact

SEQ ID NO: 101061 - DNA, 330 bp, Homo sapiens
ccctatttaaaaatctttgcttcctttgcctgtaaccaagatggtgaatatacttcttctttgtaccagttccagtaagttggttgaggttttttgaaccctacatagagaaagattccaagggttggcctgggctcagcaggaaagaataccattcatgccattttagggatatctgccatgaggatagacagaagggagctctggaattttccattcccaacgttcagaataatgccaaactctaacatgacatgaaagatcctgcataagttatttctctagttgcatttcctccctatgagccaaaagctatatccacaatctatt

SEQ ID NO: 101062 - DNA, 300 bp, Homo sapiens
catgcttctttatgcatatttttaaaaaatctaacttcagaaaaggtaaatttaaaatgcaggtgttacttccatttgaagcactattaaaaaaactggataaagatcagcagcagctacagattgttgcaagttcttgggatatccttctagcttaggaatatggctccatggcagaatttatgatcagagactcatcatgtcttcaaaaatttaaacagaattatgtataattgctagcatgcatctccatagaagctatgttatagtgagtgatttaattagcattacaattttcag

SEQ ID NO: 101063 - DNA, 235 bp, Homo sapiens
actggcattgaattttttttcaacagggaacattaatcatttgtaaacaaaactatattcttaaaccacagtgagcaaaacacactatacatccattcaagggatcacttcctactccctcttgtaacttcaattaagtcagctgtgtagtgagacaggttttgtgaatactcaaagaaaaatcagagctaaagcaatgaaagctagcatacatatccagatgaagcagagcagt

SEQ ID NO: 101064 - DNA, 749 bp, Homo sapiens
gtaatgatgtctggtccgcgttaaggcgggcagctcggcagcccacacctttggttttctggtctcaggcccattatggataagctggtgtggggtggggcaggggagtttcaggggctggaagggcctcatggcagccccacgtagaggctgcctagcccctggactggccccaccaaggggaacaggacattgcagctgggcttggggaagaagggaggcctgtccttttgattcttctttctggcatcctgtgtgtgcacgtctgtgtaggtgtgtgtacacatgcacacctgcctatagtttctttccacttggaattggttttgacaaaaaggtgcgtcagcttcccaagctggtccctgtaacagtgaaggatggagcctcatcctcatcccagagccacaccctcagcttcccctggaaaaggcagcggcttcttccgatccacaccctcagcttcccccggaaaaggcagcagcttcttctgatgcatggatacagcccccactacggagctggggagggagctgcaggcagccttgaccccagaccaaattcaaaggacctgcctcttccaaaggcctccctccaagggccacggggaccccatgaccgtcctctcatcccaagctggctgcatggggtgggctggtttatacgcagataagactgcacctgctgatgaggccagatgcaggtgaaccccggtgctgcaaatgaggagtctgcagatggggtgaggctga

SEQ ID NO: 101065 - DNA, 882 bp, Homo sapiens
gctgcacgcctataatcccagctactggggaggctgaggcaggaaaatcacttaaacctgggaggtagaggttgcagtgagccgagatcgcggcacactgcactccagcctgagtgacagagcgagactccgtctcaaaaaaaaaaaaaaacctgaatagtggggtttattaggaattattctcacacttctgacatgagggggtgcttcatgatgactcttgaatattgacatttcaagtttctaaggacagttctgctgtccctcaggcaggttgggagccattgtttaagagccagacacagcaaagttaaatttgctttaatggtttaatttagggagaaataattttcacgttgctcattgagctttcaactctgagtttgtcttcctattttgaattgtttttctttacctgtttctttttgcaaaaaaaggggacagggtaatttactctgtggcatatttagcacgcctgagggaatgaatgtgggctgctgtcagaatgtttgttgtacagagagttaaggtggtattgaggagggagattgtaggagttggagtggtgagggaaggccttacagaaaatgcagactatgaagtgggcctcagggaggttagaaaactggaaaggcccagaatgtgcagataagggcaaagaagggccttggaggcaggagagggaggactgcccaagctgtaacacaggaataagcatttcaagtgtaggggccactgaagaggccattccgtgcagagaaaggccaaggaactacctcaagaatatatgaaatggcgtttgggtgggtcggttgtgctcagttggtgatcagccaagcagttttcactggtttctggaggtcgcaactatcaaagattctc

SEQ ID NO: 101066 - DNA, 1019 bp, Homo sapiens
ctgaacaggcccttatatatgcattctgacagcctttaggacggtcttggttgacaatacacacataagccagtgttgttatcatgaaacacttcatttgaatgactattacaggctgaacaggatgtcctatgccaagaggttgtgacattttgagagggtggtgctgggagccatgtgggactcttttcccatcacagccaagttgacattttctcaggttgtaggatcattagggctgcaaagggagaaactttgtcagtggctgggtagatgtcccttgagcctggattatgcatttgaaaaaatggtttctttgccttagggaagagagtctcattttaaaaagaaaaaggtttttataacgagttcatgtattccactatgaattttgctgaaaaatctgtcctgaagtatgtctttgctgccaaatcccacgctttacagttaaccaaagttgactctgtatgacctgttacattttccttagacagttggatgtgatcacagaagggtgactgccaaagttttatttcagctcagatatagctaaatgcaagaaatcacttcctgacacctttcttctgcctgccccaccctaaatcaccatttttcaaacaagctatggaatctacaaaatggcctacctgtgttccaagttaattttgagaatggctttttatggctggtttgtaatctctttagaaaagcaaaattatgatggaaactctatgacatcctaagctgtaagcacttgaagatgaatgtaacttcaggtctgtgaagctaaatatttaccttccacatgatttactgcgtctttgttcctttccacactgagctttttctttatgtgcatcccttcatctccaagctactttttagtagccctgttatatcagtgttttgtgatgttacaaaaaagcaaagaatgtgaggtcaaattttccattacacacttcaacaggaatgccagggaacttagccaaactaaggctacaaaaaaaataaaaataaaa

SEQ ID NO: 101067 - DNA, 361 bp, Homo sapiens
caagaccatccttgagaagtcacatccaaagataaaattctgatccatttctagttttagtgtttcgccactgaagacttaacatatgtcttttacactcaggttgcaaaacacaggcccaagacaaacttaacttctcccccaaatcttccttccgctggtttttccatctcgtaagtggtgccactatccatctgttaaattgtttaggggaaacctagaaaagcactaccttaatcagtgttatccttcttcttaactgtgcgtcctaatttctccacatctttcttaagtgcagtgaccaaaccggatgagaattctaacacgggcctgacatcaaatggaaaggaaggataatgtc

SEQ ID NO: 101068 - DNA, 518 bp, Homo sapiens
tgtaatttttaaattaagactgccttagtgagaaaatttcagcaggtgagttaagggcacgaggaaagggcctttgtgcagaagtaatgacataggcaaattgtcaaaggagaggttccctggtgtatttgtagaagaaagtagacccatgtgtctgaacccagcacacagttcacttatggtggttttgaaatctgccctggaattttcatgcatcttttaaatttttggtttattttttcaagaaataaatgaagtctttattttttcaatgagggcaatgtttattaagaacagcacataaggtagaaaagaaggttggtttctaatcttggttcatctcccccactgatcttgagttttaaaagcatagagagcacgatcttctgtgggtctccactgtcagagagccctggtgagaatcatgagcggatgtagtaaaaagtgcttctttcatatcagcaggtggttctgtagtatttgcatccatagacttctatgcagcatcctttctgtta

SEQ ID NO: 101069 - DNA, 768 bp, Homo sapiens
ggacaactctcctggcccacgttcctcttgccagcactgggggtcacaggcctgagccctgggtacaggggtgccctagtcttctgccctccccacctcttaaggcacagagctgttgggtgggctgcctggggctgccatccttcccgtggaagccagtagccactctagtccatgggactcttgacaaaagcgccccgagagggcaaacctgtgcccccatactcgcctgcattcttcggactccacatgcagcagggctttgtgcctggggaggggtggccagtctgtcctggtcagtatgaaaagctgttggccccctagggacagagggcccagctaaggctgcctgaggatacaaactgcttgctatcccactcctggggagcagggtctgcagggactgagagtgggtcccaccttgagaacgcatgcaaggtccgtcctgtcttgatgtcttgatgtgactgtatgtgccctgggggctcactgtggtttacaagtggcttgtgaagctcctgggagcaggtggtacacccagtgctgaagacagggtcgccgtggaagagtgaagagcctgaccgggattcctggtgggttgaaactaggaagtgctcacaccagtcagagccaaatgaggggtgcgctatggtcactgctctgtccagcatgcgttcctcctgggaggtcctggccacctgtgcacccacccctgtgccacctccagcagtcccacctggggccacctacggtggcatggcccctggc

SEQ ID NO: 101070 - DNA, 686 bp, Homo sapiens
atttcttgatttccgtcttaattctaatttttgctaaaaatacattcaagagcaagtcatttaatttctattcattattgtgtggttttgatccatcttcttagcactgatttctatttttattgtgcagaagtgtgagaatgcagttggtaagattttgagttttttgaatttactgatatttgttttatggcaaattgtgtttttgattttacagtatgtgccatgtgcagatgggaagaatgtatattctgttcgttttaggtgaagagttctgtagttgtatgttagttttggtcaagtgtcgaattcaggtcctgaatatctttcttagttttctaccttgatgatctagctaatactgtcagtgtgatgctgaagtcacccactattactgtgtggttatctaagtctcttttaaggtctctaagaacttgcttatgaatctggatgcttctgtgttgggtgcatgtatatttaggatagttaagtcttcttattgaattgaaccatttatcattatgtaatgcccttctttgtctttttttggtcattgttggtttaaagtctgtttcatcagaaattagaatagcaacccccactttttttttcttttccatttgcttggtacatttttctccacccttttactttgagcccatgagtgtcactgcaggtgcaatggg

SEQ ID NO: 101071 - DNA, 610 bp, Homo sapiens
gggccttgggcctctgtttcttgaactgttagagaggggattaggctagatggcctctgaggaccccgcctgctctgacattctgcggtcttccaagtgggaagattttaaggtctcccttccttcccgtgctgtctccccaaagtcaaccagcctcctagaccctgttaagtaagcccatggagccccttccggtggggaaacatgaaggtttggctagaacttgggcttttgtggcatcttagcaaagaagcaatatgtttttagagaagtgacaagagaaaaggaaaggaccttgagtctcaaggggtggcaaattttgggaaggcaaatacatgggaaactcatggtagataaaacttagaaagtttgttgtgtagattcctctggtgccctctccaggctcgtaaaggtctgaaggcatctctggtgatcagcctttgtccttcctggtagagaggggaggggggacacctttgtaaatttatgtcctgcttttaggcaaataaagggaaactagagagcttttcttatatctgcttcttctcaattgtcttcggctcaaagaattcttatgccaaagtggcatatttggaggtggcatatcctg

SEQ ID NO: 101072 - DNA, 487 bp, Homo sapiens
gagtgtgccccatgtggcaggcactgtgctgaggatcggtggtgagcaaaataaacccagcctgtctacctggggctgtctgcccgatccaggaaacaacagagcgcacaggcacacactggacagatgctaacatgttacggggcttaaggagcgtcctggtctgcctggagactcagaacaggttttgtgagctggtcgggggacccctgaggtctcagtgagtgggattcagctgggtacagggcgccacaggggtgaggagacctgggcagggcagcagtgttcctgtggggctccaggtaacactagccacgctgtgtgcaagggccttactgacgcttgggaatccgagcccagcctgggcacaagggggcagggggcatcagagcatctcccctcttccccgcttcctcagtgcatctcccctcttcccccttcctcagtgcatctcccctcttccccattcctcagtgcatctcccctc

SEQ ID NO: 101073 - DNA, 330 bp, Homo sapiens
taaaggttaagtcacttgcctgaggtcacacagcagatgggaagcaggattccatcccagacctcatgctctttcaatagctactgtttggggaactgtcctttccagcaagtttgttcacatagaggctgaaggggtaggtatgcagagcctttggcaagaccagacccagagcagggggacagtagcagaacttgagatcccatgaaccagtgtgttcagggtcacctcctccattcatgccatgggaagctttccccaagggaagacgttcctgtgagggtcccaacagtgaccttacagctacgtggatcccggtcactgaggagg

SEQ ID NO: 101074 - DNA, 1121 bp, Homo sapiens
acgtcagtctcaggaacgttactgattgaattttttacgtcatgtcgggacgtggcaagcagggcggcaaagctcgcgccaaggctaagacccgttcttcaagggcgggtcttcagttcccagtgggccgagtgcaccgactgctccgcaagggcaactacgctgagcgggtcggtgccggagcgccggtgtacctggcggcggtgttggagtacctaaccgccgagatcctggaactggctggcaacgcggcccgcgacaacaagaagacccgcatcatcccgcgccacttgcagctggccatccgcaacgacgaggagctcaacaagctgcttggtaaagtgaccatcgcccagggtggtgtcctgcccaatatccaggccgtgctgctgcctaagaaaactgagagccaccacaaggccaagggcaagtagcggggctggagcagttcattactcatacctcggtccaaaccaaaaaggttcttttcagagccacctactttttcaccaagtagagctgtgttcagttttatctgatagtcgagtcattttgcaatggcactggaatgctgtatggagatgaagcaaaactaaacggcttttacaccacattgttttgagatagaaagtagacattgaaatgtttacggtacatcaagaaatttaggcgcggcagctcgcgcctgcaatacagctgaaacaataagaaaagtgaggcaagagaataacaaagggagctgaaagttagagggcagaataagtaaaagcaaagggcagaagtaaggtagatgggcgggtgaacaagaagcgagataacaagcagtgaaccttttgcagccgaaacaaaagagataatgtgagcaaggacctcgtggccggcaagatctggaacaaaccagtttaagaggcagctcttcagagatgggcatgcgtattagagaggaaaagtatccttaacaaaagcccgtatgataatcagctacttaaggttcatgcatatgggctacatatcatgcatatatttaagattataagatagaggcacaagccacagaggacaaagtaagcaacaaacctatcaataaaagggcagatgctggctatagattaggcagcact

SEQ ID NO: 101075 - DNA, 284 bp, Homo sapiens
aggaaccacgtgcctgttcactgtcactcctcagccccacaactaccattccactttccgtctctatggatttgcctattttgcacatttcatataaataggagtcatacaatatgtggggttctgtgatttatttcacttaacataatgcattcaaggttcatccatttattcctttttatgaccaagtaatattccactgtctggagagactatttttctttatccattcacctgtgaaagatactgaattgtttccccttttttggctattatggaaaatg

SEQ ID NO: 101076 - DNA, 310 bp, Homo sapiens
tttgagaaccatggatatagacaaaagtgataagatagtcttacaagggattttacactaagttgtgctcaaggaatagagaaagaaagaaatggcacaaaaggcaaacagctctggttctactgatagccctgggaaagtctgtcaaaatgatcaactttaaaaagtggtttcacataaaagctaaaaataccacttatctgacagatatgcaagaggatatacaacaatcattccttacctctcaaatcacttctttcctctctgaattgagtactttcctcatcacggtttctgctagtatacctgg

SEQ ID NO: 101077 - DNA, 660 bp, Homo sapiens
tgggcggccaggcagagacactcctcacttcccagacggggtggcggccgggcagaggctgcaatctcggcactttgggaggccaaggcaggcggctgctccttgccctcgggccccgcggggcccgtccgctcctccagccgctgcctcccgggcggccgttaattacaattttaagagcagatttctgagccatatttctgactgtgccaaataaatgaaattccttttgaatgtaatgctgtcctctagcagcagtgggtaggaaggatagggaaatggtacctggagatgatagtactgtgctcttattattattagattgttatgagattcggtttttagacattgaaacagagatgacacagaggttgaagatcccagctgcccagggtttcccccactgctttataaagatactgcctggctgggctcagtggctcccacctgtaatcccagcactttgggaggccgaggcgggcagatcacctgaggtcaggagtttgagaccagcctgggcaacatggtgaaaccctgtctctactaaaaatacaaaaattagctgggtgtggtggcgtgtgcctgtatttccagctactctggaggctgagacaggagaattacttgtaccggggaggcgaaggttgcagtgagccaata

SEQ ID NO: 101078 - DNA, 411 bp, Homo sapiens
atataaaacacaggacataaacatccattaagttatagatcttactgttatgaacagcctgtttgaacctaacacaatataaatacaacagaatctaacacaatataaatacaacaaactggtcagctgaagataattatttcatagcaaaataacagttaccaattaaatggtttcaaaagttgaatggaattaggatgaaatgaaaccaaagaaaatttccagaaaagtttaggcagacagggtgagatgcttaaggtcacaaaagctaaccattccccaagctattatttctatacagaagtcactggaacactcattataaacaaaataagctgggtcttggatagctaagtattaagaaataaaaatcatacaaaagcctaatattaaaataaaacttgaggccag

SEQ ID NO: 101079 - DNA, 793 bp, Homo sapiens
tacaggtaagaaatctttaatgaatctcaagcagcatttataaaaaatgcagtaggacagagaatatcagtgtgcattgtgtgacgtatgggtaagcactgtttcgagaatctcctgttccgggatggaaaggcacagcgtgcgtgcatgggttacacagtatgtcacagccatatcgtgggttctggtcaaaagtgctggccagcgtggccacaggtcaacctccagcccagccggcaccagcaggtgtgctgctctctccccaggtgtgccaagtgcaagaccgtcttccaccagagctgccaggctgtggtgaagaagggctgcccccgctgtgctcgctgacgcaagtaccagcaacagaacgttttcgcctgatgcccctctgctgatcccactctgaaggccgggggtgagtgtggctcagccatcccagctgggtttcctatcagcccaggatactcaccgtgtcacagctgtgtccccttgtcaggaagacctcagatgtgaccagagcactggcctcctacagaaagcccaggaagtccccatgatgtcccctggccctccccccacccctctgctgcaggaggcgtggccaccaccagatgctccctgtctggggcaggcagggccgtttactcaccaggccctggctcaccagcgtcccggcgcctccgttagggctggccaaacactgtggaaaggggacttggggaacattttcaattccacattcctgattaaaaggtctggttttttaaggtgggtttttcccattcatatttcaaca

SEQ ID NO: 101080 - DNA, 908 bp, Homo sapiens
accgggtcccaagcaggctgaattgtgctcctaggccctgccccgcccaggcgggaggtgtctgcctggtgagcagcgccaggggaatgaaaataaacaacacgggctggcctgggtcttcgaaacttttctaaagaatcgcttgtgttttgtttgaaggctcaaccaccggaattatctcttggagtctccgcataggttccgtgttgctgacctccggcagatcgcagatgaggtatatgaaggattcctcaaggccctgattgaatttgcctcccagcatgtctaccactgcgacctgtgcacccagcgcagcttcatctgccagatctgccagcaccacgacatcatcttcccctctgagtttgacaccacagtcaggtgtgccaagtgcaagaccgtcttccaccagagctgccaggctgtggtgaagaagggctgcccccgctgtgctcgctgacgcaagtaccagcaacagaacgttttcgcctgatgcccctctgctgatcccactctgaaggccgggggtgagtgtggctcagccatcccagctgggtttcctatcagcccaggatactcaccgtgtcacagctgtgtccccttgtcaggaagacctcagatgtgaccagagcactggcctcctacagaaagcccaggaagtccccatgatgtcccctggccctccccccacccctctgctgcaggaggcgtggccaccaccagatgctccctgtctggggcaggcagggccgtttactcaccaggccctggctcaccagcgtcccggcgcctccgttagggctggccaaacactgtggaaaggggacttggggaacattttcaattccacattcctgattaaaaggtctggttttttaaggtgggtttttcccattcatatttcaaca

SEQ ID NO: 101081 - DNA, 2017 bp, Homo sapiens
gggcagatgggactgtccaacccattccagggtctcatgaagctgggcaccgtggagcggcagggggcaatgggcatctggaaggagctcttctgcgagctctccccactggagttccgcctctacctgagcaacgaggagcacacctgtgtggagaactgctccctgcttcgctgtgagtctgtggggccagcccacagtgacgggcgctttgagctggtcttctctggcaagaagctggccctgcgcgcctcctcccaggacgaagctgaggactggctggacctggtgcgggaggccctgcagaaggtccggcctcagcaggaggatgagtgggtgaacgtgcagtactcagaccagcctgaggaaccccccgaggcgccccagggctgcctctctccctcagacctgctctcggagcccgcggccctccagggcacacagtctgactggtcgtccgcccaggttccagagctagatgccatcaaggagtccctgctgtacttgtacatggacaggacctggatgccctatatattttctctgcccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggccatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacgcagatccgggcccagcccctcatcaacctgcagatggtgaacgcgtctctgtacgagcatgtggagcggatgcacctcattgggaggagccgggagcagctgaagctcctgggggattacctgggcctgtgccggagtggcgccctgaaggagctcagcaagaggctcaaccaccggaattatctcttggagtctccgcataggttccgtgttgctgacctccggcagatcgcagatgaggtatatgaaggattcctcaaggccctgattgaatttgcctcccagcatgtctaccactgcgacctgtgcacccagcgcagcttcatctgccagatctgccagcaccacgacatcatcttcccctctgagtttgacaccacagtcaggtgtgccaagtgcaagaccgtcttccaccagagctgccaggctgtggtgaagaagggctgcccccgctgtgctcgctgacgcaagtaccagcaacagaacgttttcgcctgatgcccctctgctgatcccactctgaaggccgggggtgagtgtggctcagccatcccagctgggtttcctatcagcccaggatactcaccgtgtcacagctgtgtccccttgtcaggaagacctcagatgtgaccagagcactggcctcctacagaaagcccaggaagtccccatgatgtcccctggccctccccccacccctctgctgcaggaggcgtggccaccaccagatgctccctgtctggggcaggcagggccgtttactcaccaggccctggctcaccagcgtcccggcgcctccgttagggctggccaaacactgtggaaaggggacttggggaacattttcaattccacattcctgattaaaaggtctggttttttaaggtgggtttttcccattcatatttcaaca

SEQ ID NO: 101082 - DNA, 2153 bp, Homo sapiens
gggcagatgggactgtccaacccattccagggtctcatgaagctgggcaccgtggagcggcagggggcaatgggcatctggaaggagctcttctgcgagctctccccactggagttccgcctctacctgagcaacgaggagcacacctgtgtggagaactgctccctgcttcgctgtgagtctgtggggccagcccacagtgacgggcgctttgagctggtcttctctggcaagaagctggccctgcgcgcctcctcccaggacgaagctgaggactggctggacctggtgcgggaggccctgcagaaggtccggcctcagcaggaggatgagtgggtgaacgtgcagtactcagaccagcctgaggaaccccccgaggcgccccagggctgcctctctccctcagacctgctctcggagcccgcggccctccagggcacacagtctgactggtcgtccgcccaggttccagagctagatgccatcaaggagtccctgctgtacttgtacatggacaggacctggatgccctatatattttctctgcccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggccatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacgcagatccgggcccagcccctcatcaacctgcagatggtgaacgcgtctctgtacgagcatgtggagcggatgcacctcattgggaggagccgggagcagctgaagctcctgggggattacctgggcctgtgccggagtggcgccctgaaggagctcagcaagaggctcaaccaccggaattatctcttggagtctccgcataggttccgtgttgctgacctccggcaggtgagagtgtcatgcctaccccgcccagaactctagaaagacttcattcctggagaagtcagcaaggaagatgggagagagggtgtctgtagtttactgaagaagacagcagtctgcagcttttctgcagctcaggatcgcagatgaggtatatgaaggattcctcaaggccctgattgaatttgcctcccagcatgtctaccactgcgacctgtgcacccagcgcagcttcatctgccagatctgccagcaccacgacatcatcttcccctctgagtttgacaccacagtcaggtgtgccaagtgcaagaccgtcttccaccagagctgccaggctgtggtgaagaagggctgcccccgctgtgctcgctgacgcaagtaccagcaacagaacgttttcgcctgatgcccctctgctgatcccactctgaaggccgggggtgagtgtggctcagccatcccagctgggtttcctatcagcccaggatactcaccgtgtcacagctgtgtccccttgtcaggaagacctcagatgtgaccagagcactggcctcctacagaaagcccaggaagtccccatgatgtcccctggccctccccccacccctctgctgcaggaggcgtggccaccaccagatgctccctgtctggggcaggcagggccgtttactcaccaggccctggctcaccagcgtcccggcgcctccgttagggctggccaaacactgtggaaaggggacttggggaacattttcaattccacattcctgattaaaaggtctggttttttaaggtgggtttttcccattcatatttcaaca

SEQ ID NO: 101083 - DNA, 664 bp, Homo sapiens
gctgacagaacacagctggaaagagcagggtgagaggtcactgtgggcctctcccatcagtgatttggtgctatttgtggcctctgcaggcatggacatatcctgttgacattacaaaataaaatggatgcaaatattattgtttagtgtcttccaatttcttggatccttaaatagctgccaacatcgctcttcagttatttatgtacacaaagagctatttctgaatatccgtcctaattttcttctggcctgttccctgcatattaatgtattccaatgaatcccacccattccaaagagaactgaagcaagcttgtggcttgtttagatgtggtccaagtctgtgtggtcccctcagggaggtgtagtaaggatttctcagaaccggtgtttgcgtgtgagggaagcctgctgagcagagagcgtttacattgcccagtgttccgagtgcttgagtttcaatagttaccttagtttattaggaccttggaagagtaccaaagctgtgagttcctgggagttttccgtcaaaatcagtcctctggcatggtaaagaatatgtttgtaaaggaacaagaaaaaaatatataatttttctaaatatatatataggaaatgtatatatatatacacatataatatatatatagacaaaataaaa

SEQ ID NO: 101084 - DNA, 376 bp, Homo sapiens
cctcccgggttcaagcgattctctcgcctcagcctcctgagtaactgggattacacacacgcgccaccaaacccagctaatttttgtatttttagtagagatggagtctcaccatgttggccagactggtctccaacttctgacctcaggtgatccgcccgcctcagcctctcaaagtgctgagattacaggtgtgagccactgcaccccgcccatttagggaacttttataaggaacttaattgtgtcccacatgcagtagggacactggggtatggcatggccagtttaggcctttaaatgcgttcttccagcaggcagcagggtagaggattgatatgaagtgggagagcgtgggaggcctatgaacagacca

SEQ ID NO: 101085 - DNA, 735 bp, Homo sapiens
caagggaaaggcctcagaagaaaccagtcttgccgacagcatgatctctcatcctcagaactgggaggaaatacatctgtgttgtttcagccactcagttggtgatctctattacagcagtccttagcaaaccgatttagacagggctttggatgccaaccagaagaagctgtaggaattggcacagatccagagcatggacaaggacttacacttctgctgaaggcaaaggagaaacagcattatctaaaaagcaaccaagacttcaggggatgagaacccactaactattacagtccacgtgtcagtcgcgtttctcatcgtgattaacaccccagccattgatttgctcttcagtgtctagtgagcaaggctactgtgaatctttcctcaggaggactgatggagtcacatttctgagcctacagagctgagggcaagacctgagaatggtgatgtcaaaatgccaaccagcgagacctcttggtggccaggtgcttgcttgtgctcctcctgtgcttggacatcagactccaggttcttcaacctttggactctgggacttgcaccagcggcttcccaagggttctcaggccttaagccacagactgacgactgtactgtcagcttccctggttttgaggcttttggacttggactgagccactactggcatctctctttcccagcttgcagacagtctatcatgggactttgccttgtaattgtgctagc

SEQ ID NO: 101086 - DNA, 703 bp, Homo sapiens
agcaaacaaaaacttttatgggagctaaataaaaatttcatttgtgatagatgtattaattgaaacctcagtttattctgtatggatatgaattttctacaatgcacagtcctactcacccgaaggctaataaaactatactttccaaaacaaacactttaggaacccttctaagttggtagaatgcttagatatctcacagagggtagtcaataagcggggatagaacaaggccatacacacatttggaaatttttaacggtacatttctgggaagccaaaaagtatgctattaaaatcttgtcatattaagctagcaagaatatttattactaatatgatgtataaaaatcaggaagaataattctcaatcagcatgaggaagagatggcattctatacatttccagagggcatgtgtgaacaacaaaagtatatctaatatatactgttttcataagacaagctttagaaaataaaaagtgacaaaatctccctagctggtaggtacatacaagagttagaatgagagaatattacaatggcataagttaggaagagttgagaagaactaagctgggaattttttttcataaaattttaaaaatgtcagcattaccctaaatcagacttctcttaacacacaaagaaaagcaaaaacatatataatactgtacaaaccaaaaataaactatttaatagga

SEQ ID NO: 101087 - DNA, 260 bp, Homo sapiens
  misc_feature (17)..(17): n is a, c, g, or t
  misc_feature (21)..(21): n is a, c, g, or t
ctgtagtcgatcgagcnggtnccgaattcgacagtgtgcactccctcatgtcatctatgaatgatcacctgccccaggacttccttgaaggaatagcccaaattatttgctaagagttctgggggtaaaaaagcaaaaaaactaactctactgacacccttctttgtctcccagtgtttatggagcgtaaccagtgttcatagccctctgccaggcatcgcagatacagaggtcaaggagatagacatagccctgcccct

SEQ ID NO: 101088 - DNA, 294 bp, Homo sapiens
gggaggaacatgtttatgtaattctgatttctctagtggaaaataatagctaacctatgacttttcattttagtgtggtactgtaagcattactcattaagacacctttatctctcaaaaaattttgccaaaatggaaacaaaacaaaaccaactctaggtatatcctgtataaaattgaaatacaagaaaaatggcaacccttattaaatactgtccagtattctaggtaataaagaaaataaatgaagactctacctactttaaaaataacatatctaaaaaaaaaatactg

SEQ ID NO: 101089 - DNA, 329 bp, Homo sapiens
tcaagcagagacaggggaacttggactgactgggatgggctgaggggttaccacctagcatgctgcgtacccagtgctgaccagtgacacagagctccgagagggacagatgggctgctggaacaggcaacctttgcccgggagcctggagactctcgacagtcaacaagtcaaagggaaccctcttctgaaccaggtctgactcgaggcccattggcttttcgttaagaagttgccctgcctcaccaagacaggaagctgagtcctgtctgccatgtcttagcgctgtggcccgagccaagtctttccctgaccagaggcctgcctca

SEQ ID NO: 101090 - DNA, 507 bp, Homo sapiens
ccatgttggccaggctggtcttgaacttgttggctgggctggtctcgaacttattaatctctttattctctctaaatttctctgatgcatgtttttcaattgttttcttttttctattttgtttgtttcgtggaaaacctagtagggaatactgtgttgggggtcccctaaaccactctcagacttgataattcactagaagaactcacagaactcagaagaatggttctattcatggttatggtttattatagctaaagatacagattaaaccagcaaaggaaaaaggtgcatagagcagagttgaggagaaaccaggcagaagcttccggttatcctttctgagtagagtcaagtgaatagcacttaattttcccagcaatgatatgtgacaacacatataaagtatagccaaccagggaaactcacctgagccttgacgtctagggttttttattgagggccagttctgtaggctcagaatgcatatgacttgaccttagccat

SEQ ID NO: 101091 - DNA, 257 bp, Homo sapiens
acttctctgatgatgactgcctttccattgcatttatattctaccacttactgctaaaaagtcttggctaaatcttcaagattacaccactgaccatcaatgacccactatttttgctctgtatctctttcctctaattgttgggggcagagaagagtgatacaacttcttgattacgttttccttgactaattctcaatttcagattcatctcagcattccactggcattcccttaagtcctctctaccgcagaaa

SEQ ID NO: 101092 - DNA, 878 bp, Homo sapiens
gtagatggacacgcgatgaaaagtcatggagagcttgcctcttgctctcctccaggactccctggctctagtcttgggaaaatccgaccttcttatggctgccttatctgtaaattagaaataagcctttcctaataagacttatttctgtaaataagccttacctatcttcaggcccaggataaattacagctatggaaaaaaatactgcttaggagaatcacctggaaccaagttctaaacagaatatgtgtatttctttctttttgtactataaaagtaaccaaatagccagaataagccagccatttgttaaaaccccatgagtatgggaaatttttctagctagagagctttgttttttcccagtgggactttaccttgtagttttcatgcttaaaattttgtgaggagaagaaagaatttgaaagatcataaaagacagcaactctttaaaagctgtaaatttaaaagttatctattagagaaaacctatactactgccaaagggcgtttagcagttggatacctcaggttcaacaggaggaccattattcagagtttaatcagatttttaaaatttgaatgggacttcatttagtaaaactattcatggtgttctggctttctctttgcataaatgtggtcaagaatgtgtgtttagcttcactatggccagcaaacaatgatgctgtatcttatagattcccctctccaacaacatatttcgctggcatattttattctcatagccattcctatagtgtagagattttcgacaatccttgtctgcccagagcaacattacttattcaataaattgagtttaaattgcaagtcttttgcctgcaaaacttaacatacattctcatatatat

SEQ ID NO: 101093 - DNA, 258 bp, Homo sapiens
agtcttgggctacccaggagatggttactcagggaaagttctagcacccagcacaggaagcaggcagggcccaggacctctgatatggatcttggtaaataccattttctctgggcattccctccaggggaacctccctgcccagtaccagctgggtctgcaggttctaacaggtttcaggctgagcctcccaggtttcccagatggaacagataaccttccttgggaaggaaactattcccctccaggaagggcctg

SEQ ID NO: 101094 - DNA, 826 bp, Homo sapiens
gaccaacctggccaacatggtgaaaccccagtctctactaaaaatacaaaaattagccgggcatggtggtgtgtgcctgtaatcccagttgctccagaggctgaggcaggagaatagcttgaacccaggaggcggagattgcagtgagctgagatcatgccactgtactccagcctgggtgccagagtgagactccatctcaaaaaaaacccccaaaaattaaaatagtagcagatgatagggaaaagtcctatatgacatcagtatagctaattacatgcatggatttcaaaaccatttctatatatattttatttcaagttttataatagttaaaactatagaagtatttaccttccaatttcaatgattatcaagatgttacttttttacttgcaaggatgtttcttgtattcaaaaagccactacgaaagtattattttattttggagtggggaggatagtcccaaaaatttattgataagccaataatttaggattagatttagtaatttacttagtgcatagaatatcaaagaaaatggctggcaacgtggctcatgcctgtaatcccagcactttgggaggctgaggcgggcagatcacctgaggtcagaagtttgagaccagcctggccaacatggtgaaacccccatctctactaaaaatacaaaaattagccgggcgtggtagcgcacacctgtagtcccaactactcaggaggctgaggccggagaatcacttgaatctgggaggtggaggttgcagtgagctgagatcgtgccactgcactccagcctaggcaagaagagcaaaactccatctc

SEQ ID NO: 101095 - DNA, 443 bp, Homo sapiens
aactctccgcccttctggctctgaactactttcactcctactgagacgctgcatggctatgacaggggcgcctagcatggatcttagcatttggcagcaaagaaaagtggccgaagcctaggaacgtcctggcttcccttcctcttctgcctgctgccattataagtagaatggcgtgtgtacttccacgtatatgattatgccacttcttggaatgtggtcttagttttaagttaattctccacctagggacaacgctgtaagttttattttacaaacataatcttctaaataagctctaaataagtttcatcagttctgagagaaagttcttaagcacacaattcttcaatatttgatgtttcaaaaatcctatggaagcaagttaggcagagaaaaggacaaggccattcttaatgttgtaattttaccagagttcgcca

SEQ ID NO: 101096 - DNA, 469 bp, Homo sapiens
gaggttgggtgggtgggactagcaagccagctgaaagccatgtctctttcctgcaaggggcctcccttatttgagctgttttagtgcctgaggttttgcctggccctttcctctgccagggcttcttaaacagggagcagatgatgatacacccaaactcaggagatgcttgccagcaaaagcattgtcagttgcaaggatttgcctgaaaaaacctcagatgtacccaggtgtacgtgccactaggttgacaggttgtgtttaagagaccatgaccagctgggcatggtggctcacgcctgtaatcccagcacttcaggagaccgaggacggtggatcacctgaggtcaggagtttgagaccagcctggccaacatagtgagaccccatctctactaaaaatacaaaaattagctgggcatggtggcaggcgcctgtaatcccagctacttgggaggctgaggcagga

SEQ ID NO: 101097 - DNA, 219 bp, Homo sapiens
aagggttcaagagtcctaaggacagtataaggacaggaagtgggcaactatagaagcagcagatcatcagcgggcagggattcctcctggcacttgtattctatcccgctagtgtcttcagactgaagcatggccaggcttccatgccttgtctgactctaggcctacttctgcagaggagtcacagagccaggtcgtcatctgggaaaacactttgtg

SEQ ID NO: 101098 - DNA, 240 bp, Homo sapiens
tgtcgcccagactggagtgcagtggcaggatcagggctccgtgcagccccgaccttccaggctccagcgatcctcccgcctcagcctcctgagtagttgggagtagagatgcctcccacatcgcctggctaatttttgtatttttgtcgagaggggatctcgccacgttgcccaggcttgaagccggatcaagcaattgggttcttcggatttccgaaatagaccccaatattctgcctt

SEQ ID NO: 101099 - DNA, 742 bp, Homo sapiens
tagggtagtctagaggatcccaacgctctggaaaaggggctattcatgtcttccctacatagtccaaaaaaggtttgtcaacatggctaacagtgtgtggtccacaagctgaaggttttgatctgaacttcatttctagggagcaactcttcgcaagagttattagaaaagcctcacttgaatggtagtattttatgttagcaatataacaatgcaatcggacaagctgctcatcactagaaacagtattagtatatggtcgaggattaatagtctgccatccatctctagatagggctggtaggcatctgtcacctattctgtgtagcataacactatgcctttgatatatgtgcaatcaagtctgatgagctgctttaaagaaatgccctgcctgggtctcttagaaccctcagaattgtcccttatctgtcgttggtatttgtatccttgggtttgaaggatttgagggtagcctttgacatgcctcctgttggcagtgtagcagtatgtagatggtaataactgattttcttcattccatgagttttatccagaaatggttagagcattgttcctcatacccttatgtgcttatgactcaccaaagtggatctgagcccatttaacagttgtggggtgggcttcttttccctttccccaccgtccctcttcttctttcccctttcccaaccatccttccctcttctgtcccctttcctgacagtcccccttctccttt

SEQ ID NO: 101100 - DNA, 570 bp, Homo sapiens
ctacattcaaaaaacaggcaggctgagtccttagaaacatgggggtcacttggaagacatattgacgacaccttcccaccctaaaggttacacaggtgggaagctttggactccagctcctcactgcataccctgtctttagatcctgctgattctaagcaaatgccctattaaagactagcttcaggaaacagaagcagcccaaagttaaagctggggaaaactacactggctcacagcatgagttccaggactttgggaaaggccacctcccctgcactaggcaagctgaatttctggaaccctaaactgaaatttaaaatacatctttgccacagaaatagtttgacaaaagcagctggggtctgtgactctaggagttctcaagatttatgataagataacacttctatggagcctcttgggtttaattaataaccagggtttccaaggtactgtttgtactgaactataactcaagcatcctctgggctactttggcttctcagggttgacccgatgacttaatcaccttgcttctgtggaaaaacattttctaaacaattaaac

SEQ ID NO: 101101 - DNA, 418 bp, Homo sapiens
aagggcctggcccttccacgcccagagtacattctgtccagcagctctgagtagcctgtcctgggctgggtcctctgtggtgctagatgtacaatgccatttaatcctactgaaaacctcatgaggcgggtgttagctccattttggagatttttatttttactttatttttgggacagggtctcgctctgttgctcaggctggagtgcagtggcataatcatggctcactgtagcctcaacctccagggctctagtgatcctcctgcctcagacttctgagtagctgggaccacaggtgtgcaccactgtgccctgctacttttttttttttttttttttttggaaacggagtcttgctttgtcacctaggctggagtgcactggtgagatcttggctcactgcaacctctacctct

SEQ ID NO: 101102 - DNA, 174 bp, Homo sapiens
tccaagctccttggactgccaggtctttggtattggaatctgctgaataaggagggtgacagttggaggagcctttgagcaggacaggagctgaggtctaaggggagagagaaggacagcagtgagaatcaggatttcctttggtggagttgttgaagaaggagtatatggctg

SEQ ID NO: 101103 - DNA, 640 bp, Homo sapiens
acagttacttcccaggagactaccacagtaagactaataagatttcaaagagcattcttttctctttcatgaatccagcactttaaaacagtaagtgagaaagaattaaaatttcctagggaaattttccaccatctcgaaatacttctttctattaaaacccagtgatttcataaagttgtgcctttcacatatatgacaatgtagttaaatttggagttgagaataatcttttatttctcattagtcaacccaccaacaattacatgcttctcagaaacaataaaagaaacttcactttgaggcagatcatcatagacaatcacctaatttttaggcagctttattttgtttggtttggtttgctttgctttggtttggttgagtcaaggctgctttggagaacaatagaaaatttagacaatcatgtaaaatttatatgccaaacttcacttttttttcaagtactagctaatccatgtagaaatatgtttttcatctgcatgagctgtatatttatcttgatttccttctcttcacaataacctaacctatgaatgggttcctgacaatgtataataacaatggcaaagttaataaaacgtcatttcctggataacagcatgtgactttctcctat

SEQ ID NO: 101104 - DNA, 340 bp, Homo sapiens
agtggcttgaatttaaatggataagattaaggtgatagagtgtcagtcacatattttgcttacaagctgaaaatcaaatcttctttaattgcgtttctgtggcctttcatcacttttctacttttgctatactagtaacatttggtttcatgagagtattaattacttgtgaaataactggttgaacagtgttttaggttgggctgtgtttttatgctgtttctttttaagtactgcatatttttcctttatcacaatcaactgtaatgtaacttaatctgttttgaatatgtttttaagttaaaacctctgataataaaagtgaggatctgctttttaa

SEQ ID NO: 101105 - DNA, 343 bp, Homo sapiens
aaatacctaatgtaaatgacaggttgatggatgcagcaaaccaccatggcacatgtatgcctatgtaacaaacctgcatgttctgcacatgtatccaagaacttaaagtaaaataaaataataattttagaattttcattttgttcttatttagtttcaatacatggaatatatttagagtatatgaagttctatattgtcctgaaatttcccatttttttgtccaatctttttctatagcttctataacatatttatcactgttactttaaagtccttatttcttaacttgatctggagcattgggggacatttgtagttttattcctattaactctttttt

SEQ ID NO: 101106 - DNA, 862 bp, Homo sapiens
tttgaattttcagttttgatccatcatccatcattctgaatcatgtcttttggtagtttctctgcagaaaatagtactttcttacatatttgataatacctttatttggcatatacttaccaatggctgcttgattgggtataaattgtgggaatatcacgatttataaatatataaataattttttttcttttaagctcagcatagattgctcctttgttgtttgaaggcaaagtgatatcttcttttgtggataacctaatatgtaccccccaagatacttgtatgattatatgttaatctagaaaatccaaacaggatttaaatagtaagtcttcccataacctaacacttactgtcaatgttcagaccaagatatattttagatctgaaaaaaaaaatttactctattacagttagaacctttggcttcaaataatagaagtaagatcgtgtatcagttagttcctgctgcgtaacaaatcattccgaaacttagtggtttaaagtaacaactgtccatttaggtcatgattttgtggattgctggctgctctggtttgtgccagctcaactgaattctgtgggagtgtctcatatgtctgcagtcacctatgggtcatgtggctgctggataacctaggaagccttattcacttatcttgtacttggaagattgtcaaccaggatgacagaggtaactgaaccatgtgtttctcattacccaacaggcgagtttaagcttctttatggtggcctgagttcaaaagcaggaaaagaggacaaaccccatggcactaatgctttttgagcctctgcttatctcacatatgccagcatgccactagtcaagcaacccata

SEQ ID NO: 101107 - DNA, 324 bp, Homo sapiens
tgtttttgcacctgactttgatatttatctgtgtctgggcattttttagaaagtaagctctgaaggccaggtgcagtggctcatgcctgtaatcccagcgctttgggaggccgaggtgggcagatcacttgaggtcaggagttcgagaccagcctggccaacatggtgaaaccctgtccctactaaaaatacaaaaactagctctgggtgtggtggcaggcacctgtaatcccaactacttgggagggtaaggcaggaatcgcttgaacctgggaggcagaggttgcaatgagccaagtggtgccactgcgcttcagcctgggt

SEQ ID NO: 101108 - DNA, 2483 bp, Homo sapiens
agcggagcacctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttgtttgtgacattcatgcaccaccataaaaaaaagcc

SEQ ID NO: 101109 - DNA, 2444 bp, Homo sapiens
agcggagcacctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagc

SEQ ID NO: 101110 - DNA, 736 bp, Homo sapiens
gtgagaggcatcctctagaactctgtttcaatgttgtggttagtatctgtattcatattttgaatatcaaccatgtgtaagtacggtgtggcacctctatccaaagctggtaggttgtaaaacacagtgaattattgctatggtaaaatataaaaattaatcaaccaatataactaaataagactaaatgttacattgtctaaattatgcccacaaatgtttgaactctaggacattaggtagacttttgctagaatgatagattttgttacataacccttaaattctggaataaattcctataaggaaatgacaagcttaatttggaagtcttgctccataaaacaaaatacctgtgaagttactaagatttatggtgctaacagggtgggagactttaactttggtgatgcttttcagtatttttcacatctatagaacagctcacagtggttcatctatagcaacctatctttttatagaagcagcactgtgcagactctcagtgaattgctgaatggtctgcatgcctaaagcctacagcaaaggcaagaagccctcaataaagcaatatgaatgattggacttttaacaaagtatcaaagccagcataatctgaaatgaaacactggccaagtagatctcagcaggtaagtaaaaatgctacttacatgaccacctcagccaagcaaacatacagaattgacggagcctcaagaaagcatagattctgaag

SEQ ID NO: 101111 - DNA, 463 bp, Homo sapiens
tagctgggcatggtggtacacgcctgtagtcccagtttttaaggaggctgaggcaggagaattgcttgaattaagaggcagaggttgcagcgagccaagatggtgccactgcattccagtctgggtgatagagtaagactccatctcaataagtaaataataaaatcaaaaattggatagttttctaaataaccactatgatagtaacatttattgagctttcctatctgccagacagtgttagatgctctgaatatattatttctgttccaggagagagtttgcattttcccatactttttttgttttaaatgctgaaagaaattttagcaatatattgtatagagtacagtagcccacgtggtgtaaaacttgattctctggttttctgtagggctgataggtaagttgcccttgtcctgatgtgtcaacagtagagtgtaaagtgtgaagagtattttga

SEQ ID NO: 101112 - DNA, 406 bp, Homo sapiens
ctgatggttttataaagagtagtttccctgcacaagccctcttctcttgtctgctgccacatgagatgtgtctttcaccttctgctatcgttgtgaggcctccccagccacgtggaactgtaagtccattaaacctatttcttttgtaaattgttgagtctcaggtatgtctttatcagcagtgtgaaaacggactaatatagtgctgcaataaacatacaagtacatgtatcctttttatataatggcttttttacttttgggtagatacctattagtgggattgctggatcaaacggtagttctatttttacttatttgagaaatctccatactgtagaggttatattaatttacattcccatcaacagtgtataagcattcccttttagcatcctcaccaaca

SEQ ID NO: 101113 - DNA, 283 bp, Homo sapiens
  misc_feature (23)..(23): n is a, c, g, or t
  misc_feature (86)..(86): n is a, c, g, or t
  misc_feature (99)..(99): n is a, c, g, or t
  misc_feature (129)..(129): n is a, c, g, or t
  misc_feature (202)..(202): n is a, c, g, or t
atctgttgtgtttggcattgtantttggccttaaagaggaaacagaatatttggaacatagtccctgatgaatgcaaggatctctncttgtttaccaantaaaaaagaaaagaaattatacagatacanagaattggggccgggtttgccatcccacatctatcagtggctcacatctataaattccagcaccttgtgagtnccaaggtgggaggattgcttgaggccaggagctcaagagcagcttggtaatattgtgagacccctatgtctacaaaaaaaa

SEQ ID NO: 101114 - DNA, 427 bp, Homo sapiens
attcttcctgtctcattctacaaggccagcattgccctgacaccaaagccagacaaagatacaacaatgatcaaactacaggccagtgagcagagatgcaaattcctgaggagcggagatgcaaaaatattcaacaaaataacagcaaaccaaatccaaaagcacatcaaaaaaataatacaccaccatcaagtgaaatttatctcacagatgcaaggatggttcaatggttgcaaatcaataaacgtgttttataacatcaacagaaagacaaaaattatgtgatcatctcaatggattcaaagtaaagcatttaataaaactcaatatcccttcgtggtaaatactgtcaatagagtacgcatagaaggaacatacctcaatataataaaatccacatattacaagcccactgctaccatcatag

SEQ ID NO: 101115 - DNA, 1156 bp, Homo sapiens
gcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaaggtgagattaagtccagagttttgaacgagaataaatagagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101116 - DNA, 615 bp, Homo sapiens
ttaaataatttttatatttgaatattttaagacaatgtaatgttagggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101117 - DNA, 770 bp, Homo sapiens
gcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagaggctggcaggattgtaacctaatttaactttctt

SEQ ID NO: 101118 - DNA, 771 bp, Homo sapiens
gcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttagtaccaaaggtgtgaaagaacaaccttctagcctgagccatggaagcttccttgcccataagttcttcacagcaccataagggaactgcactgtttaagcccagactattctttgaa

SEQ ID NO: 101119 - DNA, 371 bp, Homo sapiens
gctctgtcctccagactagagtgcagtggcgttatcttagctcactgcaacctccgcctcccaggttcaagcaattctcatgcctcagcctcctgagcagctgggattacaggatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101120 - DNA, 591 bp, Homo sapiens
cgcccaggctggagtgcagtggtgtgatctcagctcactgcaacctccatctcctgggttcaagtgattctcatgcctcagcctcccaagtagctgggactacaggcctgcaccaccacacccggctaatttttgtgttttagtaaagacagggtttcacaatattggccaggctggtctcgaactcctgacttcaggtgatccgcctgcctcagcctcccaaagtggtaggattagaggcatgagccactgcgcccggcctgactttttcagcttttacttcatacaattttactccatttcaaaaagaaaaataaagaaaaataaagtgatgactaagggatgtagagtttctttttggagtgatgaaaatgtttttaagaataggttgtactgatggggatacaactaaaagccactgaattacatacataccttaggtgggtggattatatgctatgtgaattatgtcttgataaagctgttaaaaatttttaaaaaagcaaacagtcactatggaactctttcatgtttttagccaagtatcttcaagaccttctcatggagagaaggagagaatatgaacgaagg

SEQ ID NO: 101121 - DNA, 221 bp, Homo sapiens
aaaaaaaaaaaaaaaaaaaaaaaaaaaaaaaaaaaaaaaaaaaaaagggcggccgctcgcgatctagaactgttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101122 - DNA, 1052 bp, Homo sapiens
gcggggcctagggagtgagcggggcgcatctcccgctaggagttcctagtaaagtggcgggagccgcagctatggagccgcaggaggagagagaaacgcagggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101123 - DNA, 619 bp, Homo sapiens
tagcgagtgttttgggtgttcttagtatatctctactctctttgtattcgggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101124 - DNA, 721 bp, Homo sapiens
gcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101125 - DNA, 498 bp, Homo sapiens
gcactccagcctgggtgacagagcaagactcggtctcaaaaaaaaaagaagaaaaagaaaaatatttgatggtggtcacttttcaaataattttttaactgaactcctttttttggtaattgtaggagcaactttcagccagaggcatggatgcttctctgtctcatcagtccttagtagcactatcagagaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101126 - DNA, 1116 bp, Homo sapiens
gcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101127 - DNA, 622 bp, Homo sapiens
  misc_feature (52)..(52): n is a, c, g, or t
tattaatattattaaaaatataacaaaatttaatagagaatgaaaagctcangggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 101128 - DNA, 1138 bp, Homo sapiens
gcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaaaaggctttttaatatgaaaactatgtatttgggcacaaaaatgcaacacacagtaagaaaccatattctatcaactatgatattctgtaatctaa

SEQ ID NO: 101129 - DNA, 486 bp, Homo sapiens
  misc_feature (374)..(374): n is a, c, g, or t
gcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaaatccaaaagtgaagaaatcaagattgaactggaaaaacttgaaganacatatagcgtggacactgtgaggatcagagagagcttgtcgtaccgacacgaggacggcgagaacaaggggagagaagatcgtgggcgcgaaaaacggggcaagggaaaag

SEQ ID NO: 101130 - DNA, 4771 bp, Homo sapiens
cagtcgcgcgcggtgcagtcgggaggtggaggcaccggctgcattgttttcgggatcgaggggtgagggcgctatggcacccggctgcaaaactgagttacgcagcgtgacaaatggtcagtctaaccaaccaagtaatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtatttgcaactgtggctaaaagcattgtggagtcttgcatgagcggttataatggtaccatctttgcatatggacagactggctcagggaagacatttactatgatgggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgttgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaagataataattaaagtgac

SEQ ID NO: 101131 - DNA, 187 bp, Homo sapiens
tggcagatggagtcttgctctgtcacccagctggatgatattaaaagacaaaaggaaaacaggtgagaaagaaccacgagaactctatgggctaaatcttggcctgcctgtgtggagttaaatgaggttggaattggtttcacaggtttcccaaggtgtacaatgtttcccactaatccaggagatg

SEQ ID NO: 101132 - DNA, 3879 bp, Homo sapiens
taagaatcagaagcaactggaaatggctgcttaacacacaaaagaacaaaaccaagagccttctactagtcactctcaatggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaagccctggtatacagtggtgaacgtagagcttacatccagttgagagacaagcaattgacatttactcatttattcaaacatttattgatatccaacaagccaggcactgatctggtgaattccagaacatttagagttgaaacagtgaacaaaacatccctgtcctcgtggattttaacttctagcacagggagacagagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaagataataattaaagtgac

SEQ ID NO: 101133 - DNA, 5105 bp, Homo sapiens
cagtcgcgcgcggtgcagtcgggaggtggaggcaccggctgcattgttttcgggatcgaggggtgagggcgctatggcacccggctgcaaaactgagttacgcagcgtgacaaatggtcagtctaaccaaccaagtaatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtatttgcaactgtggctaaaagcattgtggagtcttgcatgagcggttataatggtaccatctttgcatatggacagactggctcagggaagacatttactatgatggtatgcccagcactcttcaagacactgttggtttacttgaatacaaggcagtgtcctggctcttgtggaccttctgattctcaggcagagggaatacacaattaaaagcaaatacacctctagaaattatgccaaaggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgttgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaagccctggtatacagtggtgaacgtagagcttacatccagttgagagacaagcaattgacatttactcatttattcaaacatttattgatatccaacaagccaggcactgatctggtgaattccagaacatttagagttgaaacagtgaacaaaacatccctgtcctcgtggattttaacttctagcacagggagacagagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaagataataattaaagtgac

SEQ ID NO: 101134 - DNA, 3274 bp, Homo sapiens
taagaatcagaagcaactggaaatggctgcttaacacacaaaagaacaaaaccaagagccttctactagtcactctcaatggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaagccctggtatacagtggtgaacgtagagcttacatccagttgagagacaagcaattgacatttactcatttattcaaacatttattgatatccaacaagccaggcactgatctggtgaattccagaacatttagagttgaaacagtgaacaaaacatccctgtcctcgtggattttaacttctagcacagggagacagagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaaaaaaaaaaaaaaaaaaaaaaaaaaaaaaaaaaaaaaaaaaaaaaaaaaaaaaaaaaaaaaaaaaaaaaaaaaacaaaaataacacgaaaaagaagaaaccaaaaaaaaaaaaaaacacaacaaaagaaagagaaaacaaaaagaggggcgagacagagcgaggagagacgaaggcgcactatacaacccacagagacgcggccacgcacagcacaacaaacaacgccacggtacagggaaaaaccggagcaaaacagggaacccggaaaaagacaagaaaccgccggacggagacacacgagaagacaaaaaacaaga

SEQ ID NO: 101135 - DNA, 1464 bp, Homo sapiens
taagaatcagaagcaactggaaatggctgcttaacacacaaaagaacaaaaccaagagccttctactagtcactctcaatggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactgtaagttattctatcaggagctttgtgacttgaaggaatactgtaactcaatatctttttacttttattaataaatgctgttcctatgtttttggatg

SEQ ID NO: 101136 - DNA, 369 bp, Homo sapiens
acaactggcggagcttgcttcaggacagacaccaccagaaagcttcctgaccagaggtaggatgagcacacagtcctttatcttggggaagactgtacaaataatagtttaagagcccttggtgatagacacaacacaataaggcaacccaaatttttctgcaggtatctctttctgcttatttctcctatataggaacatagtggtttgtttataatcagatacagataccataggcagtgagaagggggaattaaaataattttgaataatgtataagtgctaaaaagagattaatttcatttagatctacttctacgtagcatatgtaatctatatatgtttactataggataagagagacttatt

SEQ ID NO: 101137 - DNA, 315 bp, Homo sapiens
gtgcctgccacatagaaggtacttgacatgttcgttgactatgcattgctagtaacagttacttaaaatctaatgttgtcttttagaatttgatggagcttcttgaggcagaaaaagaacgcaataacaaattatcattacagtttgaagaagataaagaaaacagttctaagtgagtgctatttattttttctactagcatactagaatattgtttaataccacattcttaatcttgttttttttttattgccaataccctgtaaagagttatttttttaaagcattccaaaagcaacagcaggttcttttgta

SEQ ID NO: 101138 - DNA, 536 bp, Homo sapiens
ccctgtgctgcccacgggtagggaggaggagtgggcgctggtggcagcagaagcagcaccagcagagaaggaaagagcacctcgtcacctcacttaagtttcccacctgcctcacacaccagtgttcttggagggcatctccgaaatagcctgctctgtatttttattcctggggttccctcctcagggcctcacctctagagcctggttagctgtggtttgagtaggctggctacatacagagaactagaactttctgtgctctatgtgcttgtgtctttaattcttgtgagcaaggaaaagatcaaatttaagcagggaaactgaggcaaaagaagaaggatatgaaaaagaagacaaaggggtgaggacagcaaacaactggatttttttcaggaacagaggtctgccagggagtacagggaatattctggaaaaatgacaaatgctaggttgccagtattaatgcctttctttcaccccgagacagagtctacctctagcctagagctggagtgcaatggcgtgatctcggc

SEQ ID NO: 101139 - DNA, 380 bp, Homo sapiens
acacccagggtcaatactttgtatccttcaatccgatcaagttggactcagtattaactatcacaggcaatgatggtgtttgggatctttggctatcagcatcaatctgtattcacgtgtttggaaatatctgagtaatttacggattgatcgatggtgttgcaacatctttcttgtttttcagttgatgtgttttgggtcacagaactggctcaggcctaaaagctgagcatggaaataaggcttttcactgagcatagctgacctcaaacttctactctgccgtcacgtatctcttttgaatattcatattcaaatacccttattggctgcctatctatcttgcccctagggacaaaatgttctatgagccctttcca

SEQ ID NO: 101140 - DNA, 627 bp, Homo sapiens
ctcagtgttttggggaaccagaaacaaaccaataaaataaaggcgtggaaaggctactgtgagaacagaaaggagcaactggggcactgaaacaaaaacaacctgcacagaaattaaattgagccagaacgtaaagaactgaaggaagtgtctgatacagagaagagagaaagtacatttaggccaaaagaatcatcacaggatgaactaaccttctggttccaggagaaagacgagggacttggaaactgaattgtcccatccactgcagctgaaatctgccaccttaacttcctgcagagcttcaatgagaagcagagatcagccaagggcctctgagcacctattcaactcacagatgtgtgaatgatgataccgaattgctgctttaaacccctcagctttgtggtagttacatgggaatagctaatacaaataagtggtgcagaccccggacacagagctgatacacaggatgtcactgggagaaacagagaaagagtgtggttgtctccccatatctacagtttcacattctgggatttcagttacctgcatttaacggaggttgtctgaaaatattaaataaaaaattcccaaagtaaacaattcgtaagttttagaatg

SEQ ID NO: 101141 - DNA, 798 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacgagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggtggccccattccacaatcaaccgggattacatattgttcaaatttttacaaaaacctaatttcggatgggaaaagaaaaggggaaattagggcatttggcacccc

SEQ ID NO: 101142 - DNA, 543 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatgggtaaggtaacttctcacacacatagttgactctgggggcaccccacactgagtgtaggcctttgtctctcaagactgttttagggttaagctctctaggcaaggatcggtggctcatgcctataatcccaacagtttgggagaccaaggcaggaggattgcttgagcccaggagtttgagacctgcctgggtgacagagtgagagactctgtctcaaaaaaatagaaatgcagtcaggctggcattcattctctcattttcccctataatcctgagaacattatttttctaaaatt

SEQ ID NO: 101143 - DNA, 5136 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101144 - DNA, 5151 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101145 - DNA, 5980 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgagtttggcttgccttgtagcctaacctttcctgtccttgtgctatagagagccgagaggcgctttgcttccacacagatccttttcactggagaagggaggtcccctgagaggtttaccttcacagcaggttggaggagggagatctgggccagggtccccacccttcttcctcctgtttctcgtctgtttcttcagggcagcattgagtctactgtgggagaaggaaaggaaggttttatttcatttgcccttcttagaccagggctggcaagttcatgtgccttttctagagagggcagttctagcacagggcccactagctgttggcaggtatgagtatgggctcagggttgctagtttaggtctttgtatatgtttgagtgtttagatgttggtgactaatttgcagtgttgaaagccacagtatggacgagaggaggggtctgcaggctcagcttgcctcttgagtgccagtgggtgacatccggctggtcttgggcactggataccagatctctgcctctggggaggggttggttctttagccactttctcctctcaaagggtctccttaaaaggtggggtgacctcagggtttgacatacctcactaagctatttcctggacataaacctcaggcagttatagcaagattgaacaggggacatttttttcttgatctgaaaacgtcctcttcatcaaaacttcagtgtcctcataggcttgaggcagggttagccttggttccagcgcagtctccagcaagtgattaccagcctggaggggagcctgggaccactggctttccaccttctcctgggggtcctgtgtctgtgcaggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101146 - DNA, 5960 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcagccccacacatgcgccctggctactggcccacaagatccagtctccgcaagagaaggaagctctttatgccttaacggtgagtttggcttgccttgtagcctaacctttcctgtccttgtgctatagagagccgagaggcgctttgcttccacacagatccttttcactggagaagggaggtcccctgagaggtttaccttcacagcaggttggaggagggagatctgggccagggtccccacccttcttcctcctgtttctcgtctgtttcttcagggcagcattgagtctactgtgggagaaggaaaggaaggttttatttcatttgcccttcttagaccagggctggcaagttcatgtgccttttctagagagggcagttctagcacagggcccactagctgttggcaggtatgagtatgggctcagggttgctagtttaggtctttgtatatgtttgagtgtttagatgttggtgactaatttgcagtgttgaaagccacagtatggacgagaggaggggtctgcaggctcagcttgcctcttgagtgccagtgggtgacatccggctggtcttgggcactggataccagatctctgcctctggggaggggttggttctttagccactttctcctctcaaagggtctccttaaaaggtggggtgacctcagggtttgacatacctcactaagctatttcctggacataaacctcaggcagttatagcaagattgaacaggggacatttttttcttgatctgaaaacgtcctcttcatcaaaacttcagtgtcctcataggcttgaggcagggttagccttggttccagcgcagtctccagcaagtgattaccagcctggaggggagcctgggaccactggctttccaccttctcctgggggtcctgtgtctgtgcaggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101147 - DNA, 5265 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacgtgtcctcataggcttgaggcagggttagccttggttccagcgcagtctccagcaagtgattaccagcctggaggggagcctgggaccactggctttccaccttctcctgggggtcctgtgtctgtgcaggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101148 - DNA, 4876 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgatacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101149 - DNA, 4365 bp, Homo sapiens
agggctggagccctaaggtgtatgttagctggccgatggagcttacaaacattctaaccgcaggccaggcaggccccgcccgatcaggaggccctgaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101150 - DNA, 4450 bp, Homo sapiens
  misc_feature (21)..(21): n is a, c, g, or t
  misc_feature (73)..(73): n is a, c, g, or t
  misc_feature (78)..(78): n is a, c, g, or t
  misc_feature (85)..(85): n is a, c, g, or t
  misc_feature (103)..(103): n is a, c, g, or t
ctcctgttacaggcatggttnctggtcaagaattcctgtgaggaaaaagaggaatccctcctccagcaccctnccagncgggtgntgttcaagaacccttctncagacaggaatttgctggacctcctctcacacatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101151 - DNA, 5066 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagctctttctcagtgccagtgagcccggccctatccattttccatccaccatgaactccccaaaccgttattccttggacatcagtatctagagggacaagaagaagaaggtggccaagacccagggataactgtggtgcctcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101152 - DNA, 4129 bp, Homo sapiens
tataggctagcatgcatgcatgcagactgtagagtaagcacccggcagccattaaccatgcgttatctagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101153 - DNA, 3674 bp, Homo sapiens
ccgccccgcaccaggcccgggttacggcgagggttgtcccttggagtctgttacgcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101154 - DNA, 2585 bp, Homo sapiens
ggagagcgccaggacgctacagcagctgaagaggcagtggcgcccgcggccgcggcgtcggggctggagcgatggcggcgaccgcggtggcggcggctgtggcgggaaccgagtcggcccagggtcccccgggcccggcagcgtcgctggagctgtggctgaacaaagccacagacccaagcatgtcggaacaggattggtcagctatccagaatttctgtgagcaggtgaacactgaccccaatggccccacacatgcgccctggctactggcccacaagatccagtctccgcaagagaaggaagctctttatgccttaacggtgctggagatgtgcatgaaccactgtggggagaagttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 101155 - DNA, 208 bp, Homo sapiens
ggtcatgtcctgtgtgggtgtggtgttggggtggggacagtggaagaacttgctgctgtgtgttgcttcagctctttctcagtgccagtgagcccggccctatccattttccatccaccatgaactccccaaaccgttattccttggacatcagtatctagagggacaagaagaagaaggtggccaagacccagggataactgtggtg

SEQ ID NO: 101156 - DNA, 302 bp, Homo sapiens
atctgcccaccttggcctcccaaagtgctgggattacaggcgtgagccactgtgtccggtccatacttctttttttttaaaggtttgatcctgtttggattctatcagtagtgaaggcccgggattctgaaatgaaaatgtatgcagtgtttataaactctcattccttggtgttcatgagatctgtggtcagcccaatcagcctgcttagatggaatagtttgtgaagggcagagcagggtgagactgaatttcagatttagcatagattgctagaaaacagaggaatttctttggtaagt

SEQ ID NO: 101157 - DNA, 394 bp, Homo sapiens
caaggactctcttcctgacttgcagatggctgccttctccctgtgtgtttacatggcagtgagcggggagggatgggggaagaggaggttgagggaggaggaggagagaacgagaaggagagagagccctctgcttcttatgaggccactaatcctatcgaattaaggcctcacctttatgaccgcatttgaccttaattacctcccaaaagcactgtctccacatacagtcacattgagggttagggattcaacatatgaatttggagaatggtaaacacaattcaactcatgccaaccactgatctagcaggagaagattggatatatagtgtgatgtgatgtgtttaagtccaggtgtgattatagcaacagaacgagtgcaggcaaaatc

SEQ ID NO: 101158 - DNA, 357 bp, Homo sapiens
aaaggcctcctcagtctgcagttccagctccaggtaagtgcaccttctctgggtctgtctgcctgtctgcttgttagtgtgaccaaagggaaccttctgcatcattacgccatctctggcttgtttaacactggccctgggtccctatgagatcttaacagaccctagctccagtccccttcccataacccacctgggctgtgcctgaccacagaatcaaggagacgctggcctgcgagggagctgtagagcagggagcaggaagctgtgtgtgtccagccctgacctgtcctgttctgcccccagcccctcacagtgcttttcaagccatgcttcctgtgcccccagtggggccct

SEQ ID NO: 101159 - DNA, 424 bp, Homo sapiens
gagaaagacaaaaagaacaatttagaaaaatggtggaaaatctatctttcccaacaaattgactttgtgcttcctaatctatgttaacagtatcactgacacccaattatgcagaataaagacaatgttccttatctttggctccatcttcctccaatttctgttaagtcccccagaaatatctctcagctgtcctttacctttacactggtattgccattgctccaggtgaactcttgcaattgattcctaaccagtcttcctttccatgacctcctcctctcttaggccattattcacaaagccaacagtgatctttctgaagcacagactgaattgcatgactctaacctgctcaagaatcagtattaggctttctaatgcccacaaagtaaagttcaaattctttagcatggcattcaaa

SEQ ID NO: 101160 - DNA, 321 bp, Homo sapiens
agaacttttaacatagtagcctaaaactgcttttaagaagaaaatgaggctgggtgcggtggctcatgcctgtaatcctagcactttgggaggccaaggtgggcggatcacaaggtcaggaaatcgagaccatcctggctaacagtgaaactccgtctctactaaaaatagaaaaattagccaggcatggtggcgggcacctgtagtcccagctacctaggaggctgaggcaggagaatggcatgaacccaggaggcggagcttgcagtgtgctgagatcgcgccaccactccagcctgggcaacagagcgagactgtctc

SEQ ID NO: 101161 - DNA, 397 bp, Homo sapiens
gatgaagtcagaagctgaggaaacactagcaggaagtagtgggtgagagccaggagaaaagttggcagatgtggcagtgcatgggcctgggcttcctgggaaagggatcttattcacctgccaggcaagtgccttgacctgggtgtgcctggaaaacaaaattaattgaatgaatacaaaggtgctttgtaaactccatcaaattatttgttatgctaatgtcatcattactagtttctctaataaccaatcacacaattaggaagcactaactgaactttcaccttgtcacacaatccacagctggatttgccccaaggactctctttctggagtgtgtaagcagattcaattggtacccagccctctttctgatgcagaaatctagccgtgtcca

SEQ ID NO: 101162 - DNA, 343 bp, Homo sapiens
tttccccctaaactggaccaaagccttgtttgcagaacaaatggtcaattacatctacattcaaaaataaaattcaaatgtgctcatgttttcaatttaagtatgtctgttgtttgctgtttattcctttggtataaatagaagctttctggcttatttgaacgcagaacacatagtacactgtttagatacaattattcattataaattaaatcaatgcttttcctttttagaataccatgccctaactagaatctctacaacattataaaaacataaaatatgactaacgatttaatttaaggccctaattcccaatgaaagataaataatgctgctgtag

SEQ ID NO: 101163 - DNA, 184 bp, Homo sapiens
tgttcccaataaacattcactctagttatgagtaagtaatacaaattccacagaaactgtcaagtcctaagtatgatgtacaagggattatttttaaaaatccacactaaagaaactatccatccgtaggtttaaaaggtgacagaatgaaaataaggctacaaatacacacatgtaatgctaa

SEQ ID NO: 101164 - DNA, 102 bp, Homo sapiens
attagtgtttgggccaaattgcctctgcacatcctgcatatcctgggctgagtatggtgtccactctccaatgtgaaacttctgacaatggtaaaggtgaag

SEQ ID NO: 101165 - DNA, 454 bp, Homo sapiens
  misc_feature (364)..(364): n is a, c, g, or t
tgaagtaataatgactgagaactttcaaaaatgaatgacagacagcaaaccacatccaggaagctcagagaatgccaaccataataaatcccaaaaaatatacctaggcatgtcatattcaaactgcagaaaatcacaaagagaaaaatcttaaaagaagccagagaataaaaacaccttacctgtagaggaatgagaatatgaattacatctgacttttaatcagaaaccatgcaagagactagagtgaaatatgtaaagtgctgaaagacaaaaatcaccaacctggtattctatatagaaagaaattattcgtgaatgtttctcggccgtttttagctattttgcaaagaaactaaggtgncttaggatttaggaaccatttaggactttggcagacaattggttcttgggacacacattttcactaaagccccactggtttatgtgtaaa

SEQ ID NO: 101166 - DNA, 361 bp, Homo sapiens
tattattggttgaagacatataaataaatgattaatgttgggagaatacattgatcaagttaatcacaagtgaaaagagacaaaattttctccttaacattttcagataccactcaagctaattttgaaaagttctcagaaaatatgcataaggtttgtatgtctgagcaatgtaatcaagatttaatcaataaaaataagcttagactcagatcatttttcatgtttctttgatgtatcttttccaattaaaagacaactaacttataatgtgtaccactaatacagaaagacagagtgaacaatatttcattttctttgtctcagtgcttttggtttatttgaaacaaatatatctatc

SEQ ID NO: 101167 - DNA, 508 bp, Homo sapiens
  misc_feature (500)..(501): n is a, c, g, or t
gcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgccttcctcaagccccatggcanngatggac

SEQ ID NO: 101168 - DNA, 427 bp, Homo sapiens
  misc_feature (419)..(420): n is a, c, g, or t
gcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtggacaccgatctaatgacattcaatatctctgtacatcggtcatggtggagagaacatgggcctggttgtgtcagaagagtgctgccttcctcaagccccatggcanngatggac

SEQ ID NO: 101169 - DNA, 493 bp, Homo sapiens
gcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaagaaacaagaagaaagaagaaagaaagaaagaaggccaggggctgtggctaacgcctgtaatcctagcactttgggaggccgaagcaggcagatcacctga

SEQ ID NO: 101170 - DNA, 229 bp, Homo sapiens
tgtggtgccagatcttctccatgtcgtcccagttggtgacgatgccgtgctcgatggggtacttcagggcgacgaggcccagagcaagagaggcatcctcaccttctacaatgagctgcgtgtggctcccgaggagcaccccgtgctgctgaccgaggcccccctgaaccccaaggccaaccgcgagaagatgacccagatcatgtttgagaccttcaacaccccagca

SEQ ID NO: 101171 - DNA, 124 bp, Homo sapiens
aagagagagaatgagaatcaccggaatacgaaacttccctgttggacttcccaacattcttgaatgcaccaagatagcctcttgctgtgagattaataaatgaataaatgcctccatatttttc

SEQ ID NO: 101172 - DNA, 478 bp, Homo sapiens
aggagacagatgcaggcagggagcgggaggagggaatgggaatgagctgagcagcagcatcacagctggagggctggacatggatgaccagctcctcacttccaggtgtttccacatcaagcatcctgcagacagctaacaagttcattctacaaagtacagttctcaccactttatccttcctctgctcggaaacagtcaatggtttcccactgtccacaggggatgcttaacgcatgtgggttatgcagctagaaagacaaggcacaacctctttggtctctgcctcttttcatggcacagacaccaaaagccatctaatggatgaccagacaacatggagaaaagagctctcctagaaagccaaggcccagaagagtgaggagaaggcctgtgtccggcagggtctactgattctaagcctacgacatactgagaagaaaatcaactctctatcaaggaatgtgatagatgtggg

SEQ ID NO: 101173 - DNA, 623 bp, Homo sapiens
atgacaaaataataatattcttaaagagctagagaattaagagaggttagcgtgccctttcgctgaatttcctcagttgcgatatttttctttcatactgttttccaccataacaatatcccctgaggctagactcatatacttttagaataaaaggaaatttcattatcaagtggaacgaatgattcaatgctcaaatgtcctctcaaacacttgcaccaaatattcagttccctctgtgcttgaaagataaagatttattacctcccaaagctgctacttttccggtttgaactatactgattattagacaatgcttactgtgagttgaaatctgttttctggtagcttctccttcatcttagctatacctctttttttgttgttgttttttaattaagttttagggtacatgtgcgcaacgtgcaggttagttacatatgtatacatgtgccatgttggtgtgctacacccatcaacttgtcatttaacattaggtatatgtcctaatgctatcccttcccccttcccccaccccacaacaggaccagtgtgtgatgttccccttcctgtgtccatgtgttctcattgttcaattcccacctatgagtgagaacatgcgg

SEQ ID NO: 101174 - DNA, 621 bp, Homo sapiens
aacagaagttaggaggtctgcgtctgggtctcggctcaccctgggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcactt

SEQ ID NO: 101175 - DNA, 423 bp, Homo sapiens
ccaagtgtcctgtccatggctgcagtcattggccccatctcccactgatgttctctgaagccatgaggaagcagtgggactgcaaacatcccagcgctgtttttagtaatctaatgtttgcctgtactcatttcatctttatctcacctgagctttcgagataataattttatctcagagagagattgaagtccattctctacaaactttgaaacaaaattatattgttaggtttaagaaatatgatatacaataaagaggaagatgatagaattgttttggaggattttgcctaggctactctgttattaatgtggctgatatattaaatcgataagaactgataacaaaagtaatgttcataaaataaacttggctaagcataaaaaatgtaaaagaaattaataaagcaattctgtagaa

SEQ ID NO: 101176 - DNA, 272 bp, Homo sapiens
ccaagtgtcctgtccatggctgcagtcattggccccatctcccactgatgttctctgaagccatgaggaagcagtgggactgcaaacatcccagcgctgtttttagtaatctaatgtttgcctgtactcatttcatctttatctcacctgagctttcgagataataattttatctcagagagagattgaagtccattctctacaaactttgaaacaaaattatattgttaggtttaagaaatatgatatacaataaagaggaagatgataga

SEQ ID NO: 101177 - DNA, 316 bp, Homo sapiens
  misc_feature (34)..(34): n is a, c, g, or t
  misc_feature (37)..(37): n is a, c, g, or t
  misc_feature (40)..(40): n is a, c, g, or t
gcggccgcctactactactaaattcgcggccgcntcnacnggcatttgaaaggtttctcctgtttgttttcacacagggctgattctttttcatttctaaatagttccctgaaccatcactcttaaatattaattacatattaagtaaaatacctccctatttttgttattgtatagaaaataccttgacttggctgggtgtggtggctcatgcctgtaatcccagcactttgggaggccaaggcgggtgaatcacttaaggtcaggagtttgagaccagcctggccaacatactgaaaccttatctctactaaaa

SEQ ID NO: 101178 - DNA, 318 bp, Homo sapiens
aattgtggaaaaagaatcaccaaatttatttcctccatgaaaacaatgagaaaactgacaacaatatgataaataactctttgaaaattgtagaaattaagtcttacaacaaccaagagtaacatttatccaagaaagctggctgaataccaataagaacagcaagatttgtgatgttttaacttgccctggttgtatccccatttcttcagctctgagcataacagtcagtattcttgttaaaattcatcagtctagcagccactaaagatgtggttggagctctttaaagcctcatttttaaataagtgccttaaa

SEQ ID NO: 101179 - DNA, 540 bp, Homo sapiens
gcctaaaagccctttaggaaaagaattaaaagacaaacccccagaagaaagttctattgtgctatttactacctggcagggaatagggtcttgtgcccacctcattgaccgtcacttagaccaggtattaagcagaataattctctttgacaaacaacagccttatggaatccatgagaatgttcagggaaccctgacagagataagaattagtttccaagaataggaaaagatggtatggcaaatctttgcctttactttgatctgtggcaggaaactggtttttaagaaaatctgggttgttcctccacctccttttctttgtcttttatatttctgtgggtatgctggtttctagttatacacattaactgaacacctcatcactcaccaactctgcccctgtggctacagtttgtgtatgcctctctcctggagcagaggagatccttggtctgataacacactcagtcttcccaaagtcatggctctaagggaaacaagccacacacgaatccaacaggcttcgacagaggactt

SEQ ID NO: 101180 - DNA, 244 bp, Homo sapiens
cactcttcctccatcctgcctttccacagcagtcagtctggtccaagccaccatcatctgtcacccagactaccatagccatctcctaactggtcctcccacttgccgtctttattctgcacacagcagcctgagttcatacacacacgtgcattcattcatattttgcttaaaactgttcaatggcttcccatggaacttggagtctgatatcttcacaagtgtgtgcatggcccagacaatc

SEQ ID NO: 101181 - DNA, 398 bp, Homo sapiens
tctcatcattcctcaaacctagacctacttaatcagtgtgggctttaccaggattcctaagagagatgtttgaaaaaacattaaagtttgaaaagtattactttaaaacagtgacctattttcaatcttttggtatttgagttttcacttcaagtattaatgccctgatttactttcaagttctttctgtactttggaaaattatttttcttgtaagtatgccattgacaaattcactaacagatacaaattaaaattggtgttgttaaggcagcctatgaacatctctgcagtctataacagatcttactttcaaacgctttgttgagtgtcagtgctccagaaagtggattttatccactctcgggtaacttggagtatagaggttgccacatgaa

SEQ ID NO: 101182 - DNA, 525 bp, Homo sapiens
gctaattttgtatttttagtagagatggggtttctccatgttggtcaggctggcctcgaactctcgacctcaggtgatctgcctgccttggccttccaaagtgctgggattacaggcgtgagccactgggcccggccgagaaggaattttaaagtggagggataacatgaccagatttgaatttctgaaagatcgctctggctgctgatgtaccaagtgctgtggatggggcagaaatagctacacagagatcatcaggagagatggtgagaagtgatagggactggtctgggggagcagtgaaaatgtcgaaaagtggagaggtttcactagaagaggcaaaatctatgggacttggtgataattgaagtggaaagtgagaagaaagagtattggggatgatcttgttattggcatgagcagcttggtggatcatgcgattggtggcagggctagtttggggagatgataatgagttcgttgttggccacactgtgctttagggttatgtgagatgtccacatg

SEQ ID NO: 101183 - DNA, 405 bp, Homo sapiens
aataataaattctcattgaagaaggcagatagaaagtatgcattggtgatacagctaggagtaaactgtgttggcaataattgcaggaataatatcatctgattgaaaagtttttataaggccaggtacaggggctcaacgcctgtaatctcagcactttgaaaggccaagccaggaacatcacttgaactgttgacctcaggtgatccacccgccttggcctcccagagtgctgggattacaggcatgagccaccactcctggcccttatatttttcaaatatgttaaaggtatacataaccctcaacaacattttttgttaaatctctgctctttgctctttcttcccatctgtttcctcacatccagtctgctcttttttctctcttaactaaaaactctgt

SEQ ID NO: 101184 - DNA, 433 bp, Homo sapiens
agctctcttcatcccagcccttccactgagccttctggagcacacattttcattaggaaaaaaccttctatattgtcaacctcagcctccttgaatacccttgatctaacagaaacctgggtgtcccctgaggacagctctttctcagaaggcttttcaaatggtgacctcttagttctctctccacaagccacgtaccatggagatgactcttcattactgcttccaagtcatttctcctcaaacatcccagctaccttgaaatagcccatcagactactccatccatcaacgtttcttgctcgagtcatctgcagacatcaccatcactcctgctcattttctgataatctgagcacctagctcactgtctttccctccacactactcccgtgctcattttgtaaatttctacgtccctgcagacaaggca

SEQ ID NO: 101185 - DNA, 711 bp, Homo sapiens
tgagacagagtctccctctgtcattcaagctggagtgcagcggcgtgataatagctcactgaggccttggacttctgggctcaagcgatcctcccaccatagcctcctgagtagctgggaacacaggcatgccaccacactcagttaatttttattgttttgctgagatggggtcttgctatgctgcccaggctggtctcgaattcctggcctcaagcagtcctcctgcttcagcctcccaaagtactgggaatacaggtgtgagccaacatgctcagacaatgcaaacattcttaacgtaattttagcaaattgaatctaacaaaatagaaaaatgataattcaccatgaccaagtgaggtttattctaggaatgcaagattggtttaatattcaaaaattaatgaatataatcaactatagcagactaaaaaagaaaaacattgatcatctcaatagatgcagtaaaagaatttaacaaaatccaacaccttttcatgattaacaatactcaataaactatgattacaatggaacttcctcaacctgataaagggcatctagggaaaacctaacatcataatgaaaggtgagactggatgctatctccctaagagcaggaataacaataggatgactaatcctaccacttctattcaactttgtactgaaggttttagtcagtgcaataaggctggagaaggagcagga

SEQ ID NO: 101186 - DNA, 498 bp, Homo sapiens
aacaggtgctactttccatttagacttgtctgtaaaattagcctgtgaatactggcttgcctctgcaatcacttgcctaggtggggaggtgctgaaggagacaggtgtgtatacattcctttctttaaagaaggcttgttttcagttgaaaatgtggaaattaagactttcttgccttcaagaattatgatgttgtgggagtaaaaaaaaatcctaagggttaagggccagttctgccactttgttaagtgtcttcaactaagtcacttaactttctgaacctcagtctcctcacttgtaaaatggcaccataaatttttgccccacttatttcacaaggttgttgtgctgatccaagaaagaactcagatcttctggtttcatgcccatggtgtccatttcatccatctatcagtttttcatttctttattcattcatgcaacatgtattatatctcccaagggttagctaagtgaaaaatgtatgcatgttgggag

SEQ ID NO: 101187 - DNA, 666 bp, Homo sapiens
cgatctttcaactgcggttgaagacgagatcgctggaaggggagaacacacctactgcatgcgctttgttcccgctgagatgggcacaatgctgatgcattagtgtggttctccccttgcgctctttcaactgcggttccccaccttgaccacaaaacacagaaaattatttgaccatttttttgaattctcctaaatttagtacataactggtactattctagaatgcagaggagagaagttaattatttacattcactggatgccttaataaggcaaggttcttcaaagctggcccaaggatagtttttacaattttttatggttaaaaaatcaaaagacttatatatctagatgtgagtatgaaacgtatgttttattgtccataaagtttttattggaacacagccgtgcccattcatgtatgtattctctatggctgctttcccactacaactgcagagctgggtaatcgagacagagaaatgcagggctgaaactatttactatcttgccctttccagaaaaagcttgctggccactgcctcagaaccttaggttgtaagtctcacagaactggttgagaaaggatttgactctaaggaaaattactatttgaatttatttgatggtttattgagaaaatttgtttcatttccaacataa

SEQ ID NO: 101188 - DNA, 206 bp, Homo sapiens
aagtcagctccgtcctctggatggtcctcagctccctgtggaagagggagcagcctcttagagcctctggttgcagcggacagcatctgaggcactgagcagacacctgtccccatatcaagccattttcttgacatcctcctcgcccgctgtggagacggcatgtgtccaaggctgaggtgccccatcactcaggacaggtgggc

SEQ ID NO: 101189 - DNA, 605 bp, Homo sapiens
cacaacatcaggggcggcagtggcggcagcggcggcggcggcagcagcggcctcccctaccaggatccccacagtcaccattctgtccccagggggcaggcgagggggccgcggcagcgatggcagcggcggcagctggactaaacaggtcacctgcaggtattttatgcatggggtttataaggaaggagataactgttgcaagttgcatgacctctctgacagtccgtataatgtagtgtacaagagtttgcagccagggtactgtatttatggagactgctgcagatatgaacatagcaagccattgaaacagaaagaagcaactgctacagagctaactacaaagtcatcccttgctgcttcctcaagtctctcatggatagtcggaccacttgttgaaatgaatacgggtgaagctgagtcaagaaattcaaactttgtaactgtaggagcaggttcagagggctgggtgaatgctgttgagtttgttcctgggcaaccctactgtggccgcactgcgccttcctgcactgaagcacccctgcagggctcagtgaccaaggaagaatcagagaaagagcaaactgccgtggaaacaaaga

SEQ ID NO: 101190 - DNA, 247 bp, Homo sapiens
accccggccccgcccccgcgcgccgtccgtgaggtccccaccggccgccgtagccggaactgctgctgagggcggcgggccggcttcgctagggatgacagtgaagttgggcgacggcggcagcggggaggacgggctcaagaagctgggcaagcgggcggccgatgaggagtccctggaaggagaaggggccggcggcgcagacgcggccgaggagagcagcggcacaaagagggacgagaagacc

SEQ ID NO: 101191 - DNA, 425 bp, Homo sapiens
tgagacggggttttactctgtgtcatccaggctggagtgcagtcgttcaatccctgctcactgcagccttgacctcctgggctcaaacaatcctcccacctcagcctcccaagttgctgggattttaggcacacactaccatgcccagctaattttgtattttttgtagaaatggggattcgccatgttgtccaagctggtcgcaaactcctagactcaagcaatccacctgcctcagcctcctaaagtgctaggattacaggtattacccctggggaaagaatcttttaggttaccttgcaatgggaaggatagaggccggttcagttatctgactacactcatccagcacaactacaggaaatttaagatcattcatgcatgggaatgggcaggctgcacaggtaactccaactactcgaacc

SEQ ID NO: 101192 - DNA, 122 bp, Homo sapiens
tcccaggctcaagccattctcctgcctcagcctccagagtagctgggattacaggcacgcaccactaccaatcagccctttaatgcacctcactcttaaataggaacaaagattctcacact

SEQ ID NO: 101193 - DNA, 362 bp, Homo sapiens
tgggtcagcctggggtaaccaggactccaatagcagctgctgttccagatatgactacatgatcactgggtcatgtaggaattcatatgctgttgggatgtttggattttatccacagttgctggggggccagatcttttttattacaaggcatttcatttacttgttgaggtacttatttatacctgccttattccagaaaggattgtgttaagagtccacctgttaagtacagtgactagtacatagtatttgcttaggaaatatttgttgtatgaatgttgctcaataagccttccatattctttgtttttaaattggatatacaaaagtgttaattatggtgttgtccataatactaa

SEQ ID NO: 101194 - DNA, 361 bp, Homo sapiens
aaaatatatactgtttgttttgtggcctatcatatgttgtatcctggagaatgttccatttgcacttgagaaaaaaatgtatactctactgttgttgggtggatgttctatacattctgttaggtccagttggcctagagcattgttcaaactctattgtctcattgttctattcattataaaaatgtagtattgaagtctccagccattattttagaagtatctgtttcttccttcagttctataaatgtttgcttcatatattttggaactctggtatttgatgcttatatgcttataatcattatatcttcctgatgaattgacccttttattaatgtccttccaggctggagtgcag

SEQ ID NO: 101195 - DNA, 692 bp, Homo sapiens
gaggcctattttattcgatgattccattcgaatccattcgatgatgagtccatccatttcaatttcatgataattccattcgtttcaattcgatggtgtttccattcgattcattcgatgttgattccattagcttccgttggatgatgattccattcgggtccattcgatgatgatcacactggatttcattccataattctattcgattccattcggtgatgaccagggacccaacacttttctacccagtatttccctgcttcctgtctgtatcaggtgaacaaaagattataaggtgcaaattattgtcaatatttaagatgaggaaattttatgcttgaaagccagtatctctcaattattttggtagaaaacaacaacagaaaatcaagaaaagagcctgagttcttgcatgttaagagtcatttgatattaatataagccacccacccactatggatatagtacatgctcagctgttatataaacaataaggttgacagtcaattgttactcatagtaacatttgctgcattgttgttcctttagaaatgctagaaataaagtgaaatatttcctgtaattatgtctatgtacaaagagggaaaacaaagaaaaatagactgaaaattaccttttcatatgttcatgacttatttgacctaataaagtgctttgtctttaaagaa

SEQ ID NO: 101196 - DNA, 502 bp, Homo sapiens
caggtatgaccgtgcccagccttaaattttttattgagacatatatgataatatgtaaataacacaaattttaactctacagtttgatgagtttttacgtatatgtacaccacccagatcaagatatagagcatctccatttataaagttccttcatgctccttcccagccagcaattcttcttactgtcctgctgactcctgttttcaccttcatcaccatcagctcattttgcttgttcttgactcataaacagaatcatatagtaggtggttcgttcaatgtaggcagtctgtttttgctttaatcattacatgagtatacatccatattgtgtgaagcagtagttcttttgcattgctgtgtaatattccattgtataattgtataaatatatgttgtataaatgtaagtatagcacaatttattcttattggacatcttgtttatttctagttgttagctagtataaataaagcttctgtgagtactcttgtgtgta

SEQ ID NO: 101197 - DNA, 314 bp, Homo sapiens
taagagcagagagtgacagctgcttaacagctgtctcaacaatggattgcaacaatttgagagggaaaatctaaatctagactaaatctagactgcactaaaattcggggagtttttagaactggaaagaagggaatcgttttggcaacacatctcacaccaagcaagagtcagaggccaggagacggctggcacacaccaaggtgttaaggagggcaaaaccacacacaattcccttcggatttgatgaaaaagcaaatcggatttaaaagtcctcgatttcaagccagccgagccaaaggatgatctgggaa

SEQ ID NO: 101198 - DNA, 256 bp, Homo sapiens
cctccacttcccccacagagggctacctctggtcaagagcaaaagccagcaggtggcttctctgccctgagctcaagttacctccttagtcaccagacagaaatggacagtgagccctggcgaccggggatggcagatttagattttgagtgctctgcttttaggagaggcccgagtctcatgtgagtgggcgaaaaactccactgctcgtggcaatgagccctggactcagggagcagagttttgtttgggtttt

SEQ ID NO: 101199 - DNA, 112 bp, Homo sapiens
caggagagtgttggttgtaacgcaaaacgcactaacaggaatcatctgtacagagaaattcgaagcatgccttgcttctttctcttgcttttcctccacacctacacagcat

SEQ ID NO: 101200 - DNA, 238 bp, Homo sapiens
aagtatctgaaagatgtcactttacagaaatagtgtgtaccattctgacgttacaatggtggagttggtaggtgtgcccaggtcaagtagtggggctggctgcagctgcccagctggagacaatggggtacgcactagggtgacagcatggaggtggaaagaggaggacagatataggtcatgggaagaaaagaagacaggacctgctaacagactgaagaggagtgacgttcctcat

SEQ ID NO: 101201 - DNA, 354 bp, Homo sapiens
tacatttctctctttgtcccagagaaatcttagacctcagactcctgcctgtggggtgagagtgttttctccacccatccttcgctgtagggatctagagagaagctgccctccaactccccaggagtgatgtttgactgtcggaggcatcccctggtgtagcgctgtcccagggtgtgtgccctgctggcaatgtgtccccagggaaggaagaattggattgatgcttctccatccaagactgagccttgtcgacaacaggcaagtcagctgcagggttgcatggaggcgctgaaaagggaaggtgtgcaagagacccctgggttgcactgagccccaggacaccccagaggg

SEQ ID NO: 101202 - DNA, 539 bp, Homo sapiens
aaataaggcaccactgtccatggtgcagacagcttgttgacttgtacaagtccttttaatctaggaatgcagttttatactttttacatgtataaatgcatgtgtgcatgtgtatgtaaattcgacatatgtactgatctccacttggctaagagatcacccatgtgtttatgactatctctttgctctattttgaatgccatgttaatgcagcagtacagtgctgaggttacgtgcatgggctctggagccagactgcctaggcagaaaccctgtctccatccctcacttgcagagtaacctggcgtgagtaatataactatttcctccctgagtctcctccccctataaagccatcataacaattatacctgtctcatagggaagttgtgaggattaaatcagttaattcacggtaattcacttagaacatggcctgcctggtacatagtaagtgctgtgtaactgttatctcttattatcacagcaagaatgtctccattggaaaaatccttcaagtgtccctgatcctgcttgag

SEQ ID NO: 101203 - DNA, 538 bp, Homo sapiens
  misc_feature (529)..(534): n is a, c, g, or t
  misc_feature (536)..(538): n is a, c, g, or t
gtgtgtttttgcaactatgaagtgaatggtttcctggggaaaattgtgactttgtataactatttttgaaaccagaataaattatatttcacttgcatattcttaaattattaaaattttcagaagtcagtgatacagaaatactattttgcaatgttaatctgtttgagtctttggagaaagtggtttcattgtaggtacatgatgcactcttaatattttaaacaaatagttcactcttccatttaagggatatcagttccttgtataaaatgactggatatgtataaagcaattatgttgtcatgtgcctttaaccagctttagtaattactataatctcatatttatgatagttttgttaggtgacaggaccaaatgaaaatattttatgttttcccatcactttagattttatcattgtgtaaattactgggtttttagcattttctaatgtgaagttttaatcatttttaagtatacatattttttttctgtaccatttaaataaaatatttttataactttnnnnnnannn

SEQ ID NO: 101204 - DNA, 314 bp, Homo sapiens
tcatctgtaagataagtaatttaatacctgcacccccatcacatcgggatttttctggggatcaaatgcgttagataaattaaacttgaaagctttctttacaaattatttgaatgtagggcatttagtaattctcactactgttggcaacagggagaaattggcaagtttctagtggctggctggctagggtttgcatatcagaatccaactttcatattttatatcgttttcatattttccatctctttaatgcactaaagggtaatctcattgaacttatctctcgtcccctctgtttttctcctcgtatg

SEQ ID NO: 101205 - DNA, 268 bp, Homo sapiens
ataaattaaataaaataaaaaaactcttaagatttgagttttaccaatgaattcttcttaacaaaacaaaactttttatctaggttaaatgtagtaactcactaagtgattcctgagtatagatagatatttaatatgtagtggttaaacagcccatttctctgtatgtaggcttatgtcagcttattgcagcttaatgaataaaggacagtgattggagacatgcattaaatgtgtagctcttagagtgcaattctgtcttgggttt

SEQ ID NO: 101206 - DNA, 350 bp, Homo sapiens
aaaatttatatataaataaatacataaacaaactcaagtgtccaacagggctagataaggagcttacaaaaatgaagccagttgtgatgtgattcaatagggaataggtggggccttggcaaaccaaagaacatattctatctaaagtggatggccacaacttgctccagctgtggaaacttgggccatgtactgctagatctaaggattttcttttgagagatgctagatatatacattttttaaaaataaaattatcctgattttaacaacattgccttattatataaaacataccttggagggtgtgggtaagacacaatgtccttgaaattatatttcactgggtt

SEQ ID NO: 101207 - DNA, 424 bp, Homo sapiens
tttgagacggagtctcacgcccagcctggagtgcagtggcaccatctcggctcactgcaagccccacctcccgggttcacactattctcctgcctcagcctcccgagtagctgagactacaggcgcccaccaccatgcctggctaattttttgtatttttagtagagacagggtttcaccatgttagccaagatggtctcgatctcctgacctcatgatctgcctgcctcggcctcccaaagtgctgggattacaggcatgagccaccacacctggcccattttttaaaaatatatatacttctattaaatgccaagaatgatggatccaaaccaacaccaaagataaatgcacgttatcctgttcctggaggaaatcggctacacacattgtttacttcaaaccccagcacttgattcagttc

SEQ ID NO: 101208 - DNA, 305 bp, Homo sapiens
aggctggagtgcagtggcgcaatctgggctcactgcaagctccaccttccgggttcacgccattctcctgcctcagcctcccaagtagctgggactacagatgcccgccaccatgcccggctaattttttgtacttctagtagagacaggttttcaccatgttagccaggatggtctcgatctgacctcgtgatccgcctggctcggcctcccaaaatattgggattaaaggcgtgagccacctcacccgaccttcttatagtatatgttaaagaacccttggaataaaaaggaaatcataaaga

SEQ ID NO: 101209 - DNA, 586 bp, Homo sapiens
gcgagactccgtctcagaaaaaaaaacactactagcacatttttaaattacttgtagtgatctcatttgtaacacattacatttcaatcgtatactgcttttctaaagagtcactgctaagccctgaaattaactccaaatacctccctgggatacagtgccaaggaaggggcttccttgaacttcaacctctaaaagtaagcaagaattgagaaatatcttctgctttgaaaaatattcactccccaacgctaatacatcaattacatattatttgggggctaactaagctcctattttaaaatgtaaactgaagaaatcaggccagagtcattcccatcttagtgccaatcatataatcagataattagattgctctttccctaaagcctgtttagtttttttgtttgctggttttgttgttgttgggttttttaatttgtttttgttgttgttgttgttgttgttgttttgagatggatactcactgtgtcacccaggctagagtgcagcggcatgatctctgctcagtgcaacctccaactcctgggttcaagcgattctcctgcctcagcctcctgagtag

SEQ ID NO: 101210 - DNA, 421 bp, Homo sapiens
tgtatatggaggaaatcttgggtggcacgagccctgttttttgaagtcataattaaaagggctctgattcaagtgtctaggatgtttcctttattgttttatagatgaatgtggaaaaaaaattgacctttgttttggttttttgagacagagtctcgctctgtcacccagactgatgtatagtggcaagatcatagctcactgcagcctctacctctgggctcaagccatcctcccacctcagcctcccaagtagctgggaccataggcacatgccaccacgtccagcttatttatttatttatttatgagacagtcttgctctgttgcccaggctgtggcatgatctcggctcaatgcaatctccgcctctcgggttcaagtgattctcctgcctcagcctccaaagtagctgggacta

SEQ ID NO: 101211 - DNA, 136 bp, Homo sapiens
gaggctggaaaagcgggtctgtgccagaccataaaatgccttaaatttcatgccaaggatctgaagttttgcacttgctattggggattttgaaggattttaatcaagagaatactatgtttagcatttacctatt

SEQ ID NO: 101212 - DNA, 585 bp, Homo sapiens
attcgggtgggagtgaccaggtgccgtccatcacccctttctttgattaggacagggaactccctgaccccttgcgcttcccaagtgaggcaatgcctcgccctgcttcgggtcgtgcacggtgcgcgcacccactgacctgcacccactgtctggcactccctagtgagatgaacccggtacctcagatggaaatgcagaaatcacccgtcttctgcgtcgctcaggctcgaaagcactgtattttatggcgaaatgttgaaagctatgcttgaaatggaaataggtgcagtggatgagatactgtttgataacatgagaagaccaacaagatcagaacagaaaccctcaggctacaaatacatggaaatagcaaatagtgccaccacgcccagctaatttattttgtatttttcggggtctcaccatcttggccaggctggtcttgaactccttaccttgtgaaacacccaccttggcctcccaaactgctgggaatacaggcatgagccaccacaccgggccaatacatagttttttataaagagatattcgcctgtgaaagaaattgaatccatggttgtc

SEQ ID NO: 101213 - DNA, 106 bp, Homo sapiens
aggatccttttccggaggtgcactggctaagtgaagctacaccactctaaagggtgcagtgggcagcagcgccaggtcttaaaagactcggttggcttcaggtcag

SEQ ID NO: 101214 - DNA, 193 bp, Homo sapiens
agagagaaccagtggatagaatacagagcgagatcagatccccaggcacttcagataataaatgtattacataaagactataagtaggtttaaaaatgattcaaagcataaaattaggaattgaaaacataataaattatgacaatatataaggtaccatgaaaaaataaaatagagattttaaaaagaaaca

SEQ ID NO: 101215 - DNA, 298 bp, Homo sapiens
gggagaaggtggcaggcaagccaggggaggtaaaaggttggtatcggcggccaaagcaggactgaagatgtgtttgctgatgtgagcagagcaactgtcttatgcaccaacaggggtgtcttcataagagtcactggtgtgtgagaagcaagcactgggtatttcacatcaatcatctttaactctcataacagctctaaccagttaaatactagtatccccattttattttttcattttatttttgagacaggtctcactctgtcacccagactagagtgcagtggtgcaatcctag

SEQ ID NO: 101216 - DNA, 721 bp, Homo sapiens
gttattcgtccgttgataggctgccttcaccctttggccattgcaaataatgctgctataaacatgggtgtacaaatatcagaaaccctgctttcagttctttcagctatatacctagaagtgtaagtctatatcatagtaattctatttttaatatggggggacctccatactgtttttcatagcagctgcaccattttacattcccaccaatagtgcacaagagttctgatttttccacatcctcaccaacactcattttttttaaatagtaggtatcccaatgagtgtgcgttcatatcccattggagttttgatttgtacttttagagtctttaaattattactttttccatatcaaagtactttgtgggaagttggttattttacattctcataccatgctttgtattactttcccatttggatgcccttttcatccttcacctcatcctgtaaacccaaaatctaacttaaatcccaaatccaacttccactgtaaagcctttgctgacttctttacttcacattgatttctgaatttctaaaagttcctcattgtctaccacaaaactaagtatttgtttataagaaaaagctttatttagtcctatattattctctgattattccatatgttatcttccaaactagattgttaggtcttcaagagcagaagaaatttattttatacttataaacttcaagatttgctgaagta

SEQ ID NO: 101217 - DNA, 190 bp, Homo sapiens
ctttcctttcctgttcacacagtattcgattatttcaatggctactttcagaggatcagctagaggctgatgtgttgtttcaatggttatattatttatgaactgagagtagaagaaaaatttgagagcaggtttttggaaaaaatgaatttagacaaatatttagtaactgtatgatatataactcccc

SEQ ID NO: 101218 - DNA, 197 bp, Homo sapiens
ttccttataccagaagtatatagctgacaggacaaagggccccagctttgtaagtaatccaggtgaggataatagggacagagacccaggaagagtgggtgtaaacgacatctggttccaccgactgttcactatactcagccaattagtgtgatgaggaagtaacatgctaataaacagttctaacactggaatgg

SEQ ID NO: 101219 - DNA, 334 bp, Homo sapiens
cttctcccgcgacccgatacatatcgggttaacgagtaccaaactggccgcatccgggtttattcaatttggccacggcctgaggatgggagacccaaactctcgaatctgaccttcctttgtaaggtgggtagggcgggaggtgagattcccccatgatcaaagctgtttgcgtcccttcgtcaatcaaacttctggacatcgccaaggaggtcgcatgacctcaggatcttcattcttcagaagcaaaacaagttcatgaatcttgcaggcagcctccagggggcagaatgtgacgttaatcaattactagtgaattggtgaacaccctcta

SEQ ID NO: 101220 - DNA, 338 bp, Homo sapiens
tgagagaagctctcactctgtcacggctcactacagccttaacctctagggctcaggcaattttcccacctgagcccccgcaagtatgtgggaccgcggatgcgtgcaaccacacccagctaattctttaatttgtctatagaaatggggtctcgctttgttgcctagcctgtttataattgttttaaatatttcttttacattgagaaccacatcagacaatgttacctttttgcctcaaccatcaaacataatttagaaaactcgagaaaaggaatgtctccttgcatttttttctcttttttcagtttttcccttttgatgttgcaagattcctt

SEQ ID NO: 101221 - DNA, 815 bp, Homo sapiens
gttttctttatatttatctttcttggggttcactgagcttacaagtttatgttgttcaccattctcagtcagtttttggccattattcatttcttcaaatatttttttctactgccctttctcttctctttctggaactccagatttgtgacactttttgtttttgtttttgttttgtttatagttgcatcaagtccctgaggctctgttcatcttttgatgtatttttttctttctgaagttggctaatttctattgctctctcttcttgttcacatattgtctatcttcaaactgcactaaaccaacccagtggttttttattcagatattataattctctaatctgaaatgtccatttagtctttttatatagtgcatatttctctgctgagatttttaaatcttttccttcctcataagtatgttctcttttatgtccttgaacatagttgtattagctgcttaaattccttgtatgttaatttcaacatctggggtcctcccagggtaagtatccattcaaagtttcttgagcatggctcacacttccctgttatctatttatgtggcatacttttggattgtatcctagatactctgaatgaagcattgtaaagactttagattgtgttatcttcttcctaagagtactgatacttttccgttttaaaaaaattaagtcggcagggcatggtggctcacgcctgtaatcccaacactttgtgaggccgaggtgggtggatcacctgagatcgtgagttcgagaccagccgtctctactaaaaacacaaaattagccgggcatggtggca

SEQ ID NO: 101222 - DNA, 1441 bp, Homo sapiens
atgccatgtggcaaacaaggaaatttgcaagttcccggttccaaggtgttacctggcttgggagaaggttgtaaagaaatgtggcttcgaaaggtaatctacggaggtgaggtctgggggaagtccccagaacctgagttcccctcactcgtgaacctgtgccagagttggaaaattaacaatttgatgtcaactgtccacagtgatgaggctggtatgctgtcctactttctgtttgaagagctgatgcgatgtgacaaagattccatgccagatggaaatctgtcagaggaggaaaaattgtttctctcatattttcctttgcacaagtttgagctagaacagaacatcaaagaacttaacacccttgcggaccaagttgacaccactcacgagttgcttaccaagaccagcctggtggccagctcttccggggctgtttctggggtcatgaacatcctgggtttggccctagcacctgtgacagcaggaggcagtctcatgctctcagcaactgggacagggttgggggcagcagctgccatcaccaacatagtaacaaatgtcttagaaaatagaagcaattcagcagcaagagacaaagccagccgactggggcctctgacaacatcacatgaggctttcggaggaataaattggtctgaaatcgaggctgctggcttttgtgttaataagtgtgtaaaagctatccagggcatcaaggatcttcatgcctaccagatggccaaatccaactctggcttcatggctatggtcaagaattttgtggccaagagacacatccctttctggacggctagaggggtgcagagagcctttgagggcacaactctggccatgaccaatggtgcctgggtgatgggtgctgctggggctggcttcttacttatgaaagacatgagcagcttcctgcagagctggaagcacctggaggatggggcaaggacggagacagcagaggaactgagagcacttgctaagaagctggagcaggagctggaccggctcacccagcaccaccggcacctgccgcagaaggcgagccagacctgttccagctcccggggcagggctgttcgaggatcccgtgtggttaaaccagaagggtctcgctcacctctcccctggcctgttgtggagcaccagcctaggctgggccctggcgtggcactgaggacaccaaagaggacagtctctgccccaaggatgcttggccaccagccagccccaccagcaccagcaagaaaggggagacaggccccgggaagacaccgacaatgagaagagttggtcaccctgtcaccactgaaccttgatttaacagaggcaaaatgcaagtcttccctgaagaatactgggggtagggaaacttctagtggcaatgataaaaccagcagcaatgataatagaaggcaaaaat

SEQ ID NO: 101223 - DNA, 124 bp, Homo sapiens
acagccaactttcccggagcactgttatgtcttttcgggctgagatgactcaagaagaaatgtccctgatccttgtccatctccaggcttgggagaaggttgtaaagaaatgtggcttcgaaag

SEQ ID NO: 101224 - DNA, 368 bp, Homo sapiens
tggatactcacgaaagggagatgaaaagattgacaaaaatacatttaagcacaatcgactttaattcttggattgccatttaacttttcataagtttttcaagatgagtcggtgttttgccttttttgtcttctgatctcccagggattcacaccgggtatggattaatggggatatgatttgttatgagagacagtgagtaagatgggaatgaacacaaactttgaagcaagaaatccgagttccagtagtaaagccaagggagtgtaaaatcttgagttctttacctttctgtgcttcatctgtcaaacttggggcgtcattgccctataggagtgctgtgagagttatataaaagaaaatgaaaa

SEQ ID NO: 101225 - DNA, 367 bp, Homo sapiens
tgcggctggagagaggtgagtgcagccgaggctcggcggaggtgggcggaagggttgggggagtgctgtgtcgctggaggggaggaggagtgacccaggctctgagatccgggccacgctgtcccttgtgccggcgccagaggccgccgttgtctctgtgcctggctctaggaagggcgcttacggtattttgtctgttaaccgtaagccctcctctgttcacacggactgttccaaggcacagcacaactaaacacaacctgcccgcttcgcagacacacgccgcacacgcgctcccttggtgagcacagcagaagcagcattcggagacccgtacacccgaaaagcaaacgtcacacacccggtt

SEQ ID NO: 101226 - DNA, 512 bp, Homo sapiens
gtggggcgatagtgacatcatcccggagtcggtttttaagcggctgccggccgggaaccgggaagagaggaacagtcggaacgcggtggcgagtcgctgagcccgccgcggccccgagagcggctgcagccgccgccgcccagaaggagagggcgaggcgcgcctgagctgccgccgccgccaacggagtctcgggtgagccgggcagccgccgcgggccccggccggggccgggggcgcgggccacaggcccctgctccagccgccgcttgcagactgcgggcgccgatatcgcccgcgccccgctaggctgagcctcgggtcggccgaggagccgtggcagccgccaccgcccgagccgcgggcaagagcctccggaaccgctgccgcggacgcctggccgggccccgacgacgcacgttgcgcccccgggtcacctgatcacacaggacgattcttcaggctcactttcaagtgcttcgtggactgcttctgactgcgccgtctgtgag

SEQ ID NO: 101227 - DNA, 827 bp, Homo sapiens
tagtttgttgcagtgtatttttagattacaaaaaaagcaaagttttatcagtagtctcattaatcagtaaaacatttaaagtagttcgtttaaaagaaattttatttctagaatggaatgatttggatgtgacctgataaatacagtttgttattgtggtctcattaaattaatcagctttttcacactggggtaaagaaacagatgatgatactagggaatggaaacaaaattggaaacctgggttatttggggatttatattgtactctgcacagttgcccttttttttaggcgtgttccctggaaaagagggacggatgaacctggaagtaagtaaaagacattctaggtgtgtagcatcaaggcagttaatatccaagcatcagctttctctttatacatctacactgcatggcctgcaccaaataaggaactgaaccaggggtatgtttttacctccacagctgcctccttccatcagagcaccttgatgaacttaatgtctagtcacacgtcattggcatgttttctccccagcatttaattacaaagctgggaaacaaaagatgatagatacagttttactactgcatacaaacatttcttttttacattcagtattaacttatcaatataggagatgtgcatactatttcctgagctactgaagtttttttactctctctgttgataagttaatgacttttgctatattatatatttatatatatatatatatatatatttggtaagagaacataaaaacctaaaatttagtaacaaggggaaaataaagcatgatttggagatatgtttcaaattttt

SEQ ID NO: 101228 - DNA, 624 bp, Homo sapiens
gatgaagcctggaccttgttatcataacacagtatatttattcatttattccatcctagtatacacatcaagtagttttagaattgctaacccatattttgtgaaaaatacatttaccagaatataatgttggtctatagtgggttttttggtctttagtattacagtatataatcagaatactatttgccaaagttgcttagtttagttattttcttcacgacctgcttcagtgtggttaaattaatagggggaaacatcaattcctaaaactcaaaagcaaaatgaaacaattgaatctagctgtgtatcaagtgaatagcttataactcacagaaaaggattatttcaagggtctgtatttcatatgtttatacatttttatttctatataatttcattttgcaactccagtgtaccctttatccagattcaccagctgtgtttacattttgcctcgactctatcatttttgccctttctcactctctcctttgtgtctctgtccctttctttctctgagtacatgcatagacacacatcactttttgtctgagctatttgagagtaagttgcaggcattgtacccccttgtcccctaaatactttcagtgtgtatttcac

SEQ ID NO: 101229 - DNA, 462 bp, Homo sapiens
tgagacggagtctcgctcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagaggcagggtttcactgtgttagccaggatggcctcaatctcctgaacctcatgatccgcccgcctctgcctcccaaagtgctgggattacaggcgtgagccactgcgcccggccaagaggtttaatttttaaattttattttttaatagtgtctcttatttggtcctgctgcacctatgttttagttgtctttcaacaactaggaaacatcttctgtgcccatataaatgtgagagaaacaaacatggtgtttgtcctcacatagcttataattgggctgacagcaactgaacatct

SEQ ID NO: 101230 - DNA, 312 bp, Homo sapiens
tgtggtgcagagagacagagagagagaaagagagagggagggttctgggggcagtggcatggacagatttgggtttctgaaagattgcccagctactgggtggagcatggattggaggtgggcaccaggaggctgttagttttgctggcacctagtaaagcagtgttgccctgaagaaaggggctaactggaaaattacttaagacagagacctaacaggacgtggtggttcctggaaggtgactctgacttctggtgtcaccatcttggctggctcctgggatggtaggaataggttgtggggaggatgag

SEQ ID NO: 101231 - DNA, 450 bp, Homo sapiens
atggaggttacaaatttccatttctatgttaacactatacaaatttataataaacttgataaaacctgttacaacccattttgattactcacacgacatattaaatttacaactttaattgtggctactttccatgctactgtatcctatgttctattgtactgtacatcaaaaaccatagctggccagccacagtggctcatgccagtaatcctaacactttgggaggcaaaggtaggagggtcccttgaggccaggagttgagactagcctgggcaacatagtgagacccgtctgtaaaaaaattcaaaaattagccaaacgtggtggtgcatgcctatagtcctaactactcaggaggctcaggtggaaagactgtttgagcccaagagtcaaggctgcagtgggctataatttataattgtacggctgacagagcaagactctgtc

SEQ ID NO: 101232 - DNA, 425 bp, Homo sapiens
ctttcatcctcagttttccactgctttccctaacggaccttgatggtagcctgctatggcagaatcaggaccaaaagggtccccaggtgcacatgtccccattcttttgcatcccagcctggctgctgagatggtgtggcccagaggcatctgggctgtttctatgctcatatcacgtacacagaacagagtagggaggcgtgagatgaatgagatttgagctccaatagttgccaacacaaaacaagccgtgaattactctgagtcactctgaagcaataatacacagctcaaaggactggacacaatgaggcagaatgaagtaacgcagcatctcctgctgccgcttccctgagccaccggctttaaaggcaactttcttcccttggcagaagggtgaggagagtgttgactactgtgacaga

SEQ ID NO: 101233 - DNA, 436 bp, Homo sapiens
tagctgggattacaggcatgtaccaccacacctggctaatttttgtatttttagtagagactgggtttcaccacgttggtcaggctggtctcaaactcctgacgtcaagtgatctgaccaccttggcctcccaaagtgctgggattacaggcgtcagccacgtgcctggctgcaatctgttactgtgaccttgacagggttacaacctttacattctactttataactacagtttctgcagttctggatttaagtggatttaatgtattcatcagcagtcctcttccaatagctttccattcctgagttcttagttggctatattgtatggtcaagaaattttttcaagaaacgtcgcaagtgtttgagaatggagtatatacttgttgtcatcgtggacagtcagcttagctgggcttaaaattcatgggacaca

SEQ ID NO: 101234 - DNA, 332 bp, Homo sapiens
accatgtgaacctgtgattttgtgtcagagtgagcactactaaatctcattttcttccctgtcttctttttcatttccaaatctgcccagaagacagtaaaagctcattaatttgaaccctgctaatttagaatatgtaacatttcctccaagctcaccatgaaggaggaatttgtgaaacaaattaatagtgtgaacataattagaaaagatgagtcttgtagtgttgggaggtacctggaggtgatccagtccttttcattggtggcttgtttcttttcaaatgaggaaatcgaggcccagtgaggttctgtggctcttccacactcaca

SEQ ID NO: 101235 - DNA, 159 bp, Homo sapiens
agagataaggaaaacaacgtgtgtgtgaaccaaacaggactatcgacagagacagcataaaaaggaacaaaacagaaatcctggagcttttaaaaggtacaatgacaaacatgaaaagctcatgctagcagttcaatagcacatctgagcaggcacaag

SEQ ID NO: 101236 - DNA, 484 bp, Homo sapiens
gaaaattctgtctgaccgtgaacaagccactgtaaacaaatccgaaagatatacaccttcaaacagttctcagatgcatgctgtccctgggtggggctgttgaatcccactgtgggagctggaatgtcaatcagaattatcaaggatactatttattggcatgagtgtgttcttgtaagcacttacccttcctatctagttgctcgaaactgccagcaagttttgtttggggcaattaaaatgctatgtgaccccttagaaatttctgtcttgagggtgttcaaatttttaaagatacagaatattttgaggttttggaataaaaagcacttgttaatatataaaagaaactgtgggcatatttcctttcttccatgaaatacgcttagcctgcttatatcctttttaaaccaaggatatgaataaatctgcccaaatattttctttgggatgggaatcattctctaagtagatgatgttttaa

SEQ ID NO: 101237 - DNA, 743 bp, Homo sapiens
atctgtgcttggctgggggtgacccggagctccctcccaccaaccttcccagccgggctccctcgcagcccggagccaagcctgtgcctgccaccatttcctggcagtgtgcttagctgtgacagtttctacgtctgtagaatggggatgaaaacagcacctgctgcccagtgtgggctttcgcggtctcatgaagggtggtggcggcgtgcgctgcatgcctagcagcagcgctgtttttctcattagcacttagctccgtctcctttgccttccattgtcgccgccttcctttggccacaggagcctctgcggccagccttcccgttgcatttccatgttgttccttgttccggggaggcccctttgctgccctgcgccgcgctccgcccctcttcccgtcctgcgatgaggccctggcccccggcatcgccacgcggatccgcgcctctggtttgcagtgggtgggggccgcagtcagactcccgccctgagccccgctttccctcgcgttgcctgcccagccgggctgatgaccgacctcggcggctaaacgccttctccagctgaaacagagtccagagttccactgtttaacaaggaggaattggcaaagcagaactgtcacttggaaaatgctgttttcatgatctctttgagttttcactgtttttaatgcaagctcggaatcaatatttagttttgagtgtggagaatagattgttttttcttttatatatata

SEQ ID NO: 101238 - DNA, 704 bp, Homo sapiens
agtgtgtcccaaaatgggggctgctccctttgacctgtctccaagactgaagagaacagggaccatagctgtacctatcctgcgagggacaaaggaacaagcttttgttaattcaagcgattgagatttgggggtttgttaccacagtgtaatttggcataagctgactggcatacggtggagcatcccagatgagggcaagctcccagggcctaacagagtgagtggctggagtatgtgaaggtgaaattctttgacatgaagtggttaaggtcccacgaggccgtggtgttagatgggtcattcatgtgatgttgttatcatccaggaagctggtaggaggtaggaacccaaagtctgtaatgaacaagggaaagtgtgagcaaagtcagcagatgacagcagtaaaggaggagtaaaggggagtatagatctaaatatatatatgtatatgtgtgtgtgtgtgtgtgtgtatgtgtgtgtatatatatgcagagatttggtatatatatgtgtatatatatatgtgtgtgtatatatatgtgtgtgtgtgtgtatatatatatatgtgtatatatatatatgcagagatttggaagtgtggaagaataggggtctgagtgcagtactggggaggccccataccctatcctgaaagcacatgaggtatgggaaagtgaccaccaagatcctttggagggaaa

SEQ ID NO: 101239 - DNA, 180 bp, Homo sapiens
aagataataaacgtgcgtcgtcttaagcaactgagattgcgggaatctgttagcagcagcaagaggagcggaatgctccacctatcctaagcatgctccagggagaggggcttgattgaagacctggagctgaccagcgtggcgcgtagcaccccatcagccttgccacaagcagggtcc

SEQ ID NO: 101240 - DNA, 388 bp, Homo sapiens
gaaatataccccattttatagctatttggcatattatccagtcatgtctcaatggtgtttagtgtattctgcactactctgaaatttaaccacctggaagaagttatgaataagaaaaaaaattctctgtcaattatttctaaaggtcatagagttaatgactagctggaaggttaattagattctgaaaacctcttcatatcaattaaatctcttatctttatgttttagtaaataaactgaataactatttagagctactgttctagggtaagaaacgttgtaaacagtaaaactacacaatgggtgtttgggttttttcctcacattaaaaaaaaaaatagttatagcaggcatggtggctcacacctgtaatcccagcactttg

SEQ ID NO: 101241 - DNA, 887 bp, Homo sapiens
gatatttagttataacagagactaaagaagaaagacgcttactgaataaggtgggatccaacaagagtgtagtatggaatgcaatagcttatgaattactttttttctgagggagctcaacagaatgacacctaagaaagggaaagtctttgacacttggtacgtttgtgatttttggtcattacttgaaaattaataagtttgaaatcactactcttagaaatggaagaaagtgatgactctaatcagcctatctcagcgtgtaggcaagaaattcgaaagagaagatgacccagcaaaccaatggtaggcaaatcccagcaaactgatgtaatagagaaaaagaaacacatggccataccaaaatcatctagccccaaagctacccatcgtattggtaatacttctggaagcaaaggcagctactctgccaaagcctatgagtctattagagtatcttctgagcttcagcaaacttggacaaagagaaagcatggacaggaaatgactagtaagtctctccagacagacaccattgtagaagagaaaaaagaagtcaagttagttgaggaaaccgtggtacctgaagaaaagtcagctgatgttagagaagctgctattgaattgccagagagtgttcaggatgtagaaattccaccaaacataccttcagttcaactaaaaatggacagatctcagcagaccagccgtacaggatactggaccatgatgaacatcccccctgtagaaaaagtggacaaggaacaacagacatactttagtgaatcagaaatagtggttatttccaggccagatagttcttctacaaagtcaaaggaagatgccctgaaacataaatcgtcgggaaagatttttgctagtgaaca

SEQ ID NO: 101242 - DNA, 347 bp, Homo sapiens
taccgtataaaaggcgaaacagtatacctgtagagagcacttaccatgaatggagcttgcaggagtagaagttgctctggatgagtcagtgagtgagtggggagtgaatgtgaaggtctaagacattactgtacaccactgtagactgccatagccttcacaaatactgaactaaggatatactcagtttataaaaatattattctttcttcaaaaataaattaacctggctgggggtagtggctcacatatggaatcctagcactttgggaggctgaggcgggaggatcgcttgagcccgggagttcaagaccagcctgggcaatatagtgagaccctgtctctac

SEQ ID NO: 101243 - DNA, 139 bp, Homo sapiens
cccccaggccctggtccttggcagattttattgatcaactggagcaaactgcatggtccacgccagggctggcctgcatggaaggagccggagcatgtgcttagacaaccctggatggagcagctggggaaccagggag

SEQ ID NO: 101244 - DNA, 258 bp, Homo sapiens
cctcactgtaaattcagattcatcctttattgagcacctactatgtgccaggcattgggttgagtgctggcgataaagtaatgagcaagcccttatcttgatgaacagttacggaataaaatagacctgcagaaataaacacgcaattcacaactgaggtgagcatggttggtgggggaatggagagcacataataaagggtgtggcatggttgggggcatcagtgaccttctccctgagaaagagacacttgagtga

SEQ ID NO: 101245 - DNA, 180 bp, Homo sapiens
attcaatagggaataggtggggccttggcaacatcaatttgtagtatccctgccaattgatactacaacatcaatttgtagtatccctgccaaaatttaactatggaaaatagttaaattttaatatgcacacatctgtggttgtggttatacagatatatatatatatatatatatata

SEQ ID NO: 101246 - DNA, 333 bp, Homo sapiens
tacatgtctgagttatttgcatattactttcaggaatgcatttcattcacgatttctgggggaagggtgtctgggcttcggagtctcttggctgactaatctcacgaatttctgtgcaggatttcagtcactgcccccctcccttttctcaggcctgggatggtgcctgtctagcctcttggggaggtttttagcttgaaggaattgttatttgctctccaaggagaataccaggtgaaaatggcccattctgtggtggctaatggcctgattgatgagtcatgctcacagaactgctggggcctgggcctggctgctcacacggacttaccc

SEQ ID NO: 101247 - DNA, 497 bp, Homo sapiens
ggtcggaccacatggctacggagctcttgaaataaatgtggccatgtgtggcttttagcttctatattggatagctccactgtagaacattttaaacatcactgcaagttctgttggacagtactgctttagcaagcaggtgaaccttttggctcccacttcggcttttttgaggagttggtaaaatatgaccattaagcataactttggagttatgctgacttcagattctgattctggtttctcaaatcctgcctgacattgaacaaacaacttgccttcagtttcatcatctgtaaaattgagataataatagcccctcacagacttataaaatattatatgagagactgtattagatatatgtggttagtacttcatatggtttggctgtgtcctcacccttctcatcttgaattgtagctcccataattcccacgtgttgtgggaggcacccggtgggagataactgaatcatgggggtggtttcccccata

SEQ ID NO: 101248 - DNA, 362 bp, Homo sapiens
tactgactgccagggcacttgggaatggcaaggaaaccgttaccattactgagtttagtaatggtaatggttctcttgctatacccagaaaacgtgccaggaagagaactcaggaccctgaagcagactactggaagggagactccagctcaaacaaggcaggggtgggggcgtgggattgggggtaggggagggaatagatacattttctctttcctgttgtaaagaaataaagataagccaggcacagtggctcacgcctgtaatcccaccactttcagaggccaaggcaggaggatttcttgagcccaggagtttgagaccagcctagacaacatagtgagactcagtccctaatatta

SEQ ID NO: 101249 - DNA, 241 bp, Homo sapiens
tgagtggagggtgacatgatcagattttgcgtgaaaaacattacattggctgcttggtggagaatggacagggaatgagggttgagaggaagaggcaaggggcaagagttaggagtctctgcctgcggtccatgtgatgtgtggtgatagctggattagggtggtgtctgtgagaaggtgtgaagaaaggaattaagagacctgtccagaggcagaatcacaggctttcaggaagaggagg

SEQ ID NO: 101250 - DNA, 417 bp, Homo sapiens
tctacgaccaaatgacagcttcagacttggagaaaatatttgcaaatcatatatctggtaagtctagtattcagaatatatcaaaagctcaatgataaaaaagacctgattaaaataaataaaccaattaaaaagtgagcaaaggacttgaatagacatttctccaaagaagatatacaaatagcccagaagcacatggaaagatgctaacatcattagtcattagggacaaacaagtcaaaaccgccatgaaataccacttcacacacactaggatggctacaatttttaaaaaattgaaaataacaagtgtttctgaggacatggggaaattagaaccttcctatagtgctggtgggaatgtaaaatggtgcagccactgcagaaaacagttgatggtatttcaaaaagttaaac

SEQ ID NO: 101251 - DNA, 590 bp, Homo sapiens
cacagaaccatacaactttcaatattgtcaaacacaccaagtaatttatcacatcatatatccccaccttcctctttctgttttcttataacatatcctcttataatttcctgaaaaggggtggacagaaggtaaatactttgtgattttgcttctctgaaaatgttagcattctaccttcacatgtgattgatgctttgactagatacacaaatctacaggaaatacttttgcatcagaattttgaaagcattattccactgtcttctagcttccaaccagaaggtgagtctaatacagcttgaatcctgttcctcagtacacatagtagggatttcttgcactcagtaatatctggtttgcctgttctgtttgggcatcagggaggactgcacatcccaactccctagcactgaggaagattcataggactgatgctagccagggccaaagcatttaagagaaagtttaagttttttacaccttatcccaccacaggaactctagaagctgtgtgttgagacagcaacatcataagatagtaaagactccatctgtctagatctctgagtgacaatatggagcagagt

SEQ ID NO: 101252 - DNA, 553 bp, Homo sapiens
tattgctcctttgtgaagtactggaacatgttctgtgttacacagtacccccccttacccatgcttccactttcctaggttttaattacccacagtcaactgtgatctgaaaatattagatgagaaattccagaaataaacaatttgtaagtttcagattgcatactcttctgggtagtaccatgatgaagtctggtcgtcctgctgtgtccagcccgggatgtgagtcattcctttgtccagcatgtccaagctgtgtggcacgtatgggcaggaaaaagcatagcatatacggggttcagcaccatccacggtttctgacgtccacatggtggggggagggggcgcttcttgaaaccctcatggatgagggggactactgtgaaccaaaagcttaatttaaagaggtgaccacagactattattgcactatttcagggatttagttatctttttgaattgtaaacagataatcaagaacaaacattccggaagatgtttcttgtttcctttgctttttattttcttctgatgcttcttggtgtcttttctt

SEQ ID NO: 101253 - DNA, 452 bp, Homo sapiens
aggactgatgggtgggcttccagaaagttcttaaaagtcatcccttcctccacgccccacaaagcctcagttgtccaagtttgtggctctggtttttctctctcatccctccctctgctcttcagtcagcaggatggggaaggagccttcttgagacactgagcataacagtgtcaccctcaggatagtgaagggtggagccgggggtggaagttgcagagcctgggacacctgccttggctgcaacctctgcactgcttttatttatctacttatttttatagagttgaggtctcactatgttgcccaggctggtctcaaactcctaggctcaagtgagctccggccttggcctcccgaagtgctgagattacaggcatgagccaccgcaccacctgcctgtcttactgtgtgagaaaaaaaataaacggtgatgtgattaaaacactaga

SEQ ID NO: 101254 - DNA, 419 bp, Homo sapiens
cggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtaattagacctgggaaagcagggagggcagggacgtgcacacgaggaagagacaggcacgtgtgtagtcagacagacagacagacacgcatccacccacagaagcacagagacgcatagagagccagagatattgctagagataaagacacagagaataaaggagtgcccccagatttagaatgcaatgaatgtgagagccaaggggtgaggaccagacgggcgactatggaggaggggagcttgt

SEQ ID NO: 101255 - DNA, 2186 bp, Homo sapiens
caagtgtttgtgagtctgtgtgtctgagtttgcaagtgagtgtgtgtctgtgtgccgggcgttgtgtctgattgggcaaggttccaggggtgctcgcttgagtcctgagctgggacaacgccttgactcttcttctttaagacctccaagcctcagggactctgggaatcaaggggtgtttcttcttgttttgtttgaggaggaatgagaagggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactggaaaaaaaaa

SEQ ID NO: 101256 - DNA, 2071 bp, Homo sapiens
cggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccatcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactggaaaaaaaaa

SEQ ID NO: 101257 - DNA, 1458 bp, Homo sapiens
acccacgcgtcgcggacgcgtgggtcgacccacgcgtcggtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactggaaaaaaaaa

SEQ ID NO: 101258 - DNA, 131 bp, Homo sapiens
cggccgcctgccgcaccacagcgccatcctcaagcgcggtgagcctggctgggcgggtcggcgctgccgcggaggctagggggtgggcggcagggcgaggcgcgcggaggcgggaagggatggtttcgcgg

SEQ ID NO: 101259 - DNA, 2145 bp, Homo sapiens
cggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactggaaaaaaaaa

SEQ ID NO: 101260 - DNA, 2056 bp, Homo sapiens
taggagcccgaagaagggcgtcacttggttccccaagcgagccgtcctattcctgaacccgcatcaagtctcccgtcccgcaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactggaaaaaaaaa

SEQ ID NO: 101261 - DNA, 410 bp, Homo sapiens
atgctggaggagccccggccgcggcctccgccctcgggcctcgcgggtctcctgttcctggcgttgtgcagtcggtgagcagttccccttgtctcccaggccatagaaacaccgacccggggtggggagagttggaggggtctggaccgcagaccccagacgccttcttggttcccagggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgc

SEQ ID NO: 101262 - DNA, 721 bp, Homo sapiens
ccacccacccaaaaggagagcagccaatctggggtcccaagtttaatggaggaagagaatttacccagaatagtttgttcatattcacacagtggttttaaaaacaaaaaaattgattctgctccagaatattctaggtgcattttctgaccttctttttctattgcagattaagaaatggggccaggggagggaaggggggtgtgatttcttttcaggttattttttaatatttatttttaaacaaattccattatttggaggcttctggtgtttagacttcaaatctactaatcttagtccataattcactcatgggacagtccctaaacatttttccagagacagttctgagacagggtttgtttaaaactctgtgacaaggtgagaaaagatctataagtcagagaaacaagactccatcatctctacaaaaaaattttttaaattattaggtgcgcgtggtggcacatgccaatagtgccagctactcaggaggcttgaggtgggaggactgcttgagtccaggagtttaaggctgcagagagctatgattgagccactgccctccagcctgggttacagtgagacactgtctctaaaaaataacaaaatttggggtcaagtgtggtggttcacacctgtaatcccagcaggaggatcgcttgaggccagaagtttgagaccagcctaagcagtatagcaagacccagtctctaca

SEQ ID NO: 101263 - DNA, 335 bp, Homo sapiens
aaaaaaatcgatgccaagtcaaacataaaattatagaaatctaccataggattatataaagagaccaattttatttagattgctagttttaaatttagtctctatctagatttctgagctctgggcagagcccacactgaaaccctggttctccaaagagaaagatatcatgggcctattccgaagagactaggccatgtagtgcttttacagtgcattttgttacaaagacttttctgtaagtctctaaactatgtcctttcttaaacacccaagagcagcccctgtggtaataactattttagtaaaaaaaacaaaaaaaaaaaaaacaaagg

SEQ ID NO: 101264 - DNA, 262 bp, Homo sapiens
cccactgcagtctgtggatggggagaggagggaagggaggaggggcatgtctcagaaagagaagaaagataagcaatccagtaggtgcccactactggaccctatgggcatgagatgagcccatgcccttttcgttggtcattgctttagtagtagcggaataatgaacactcacagactcttgtgtttctcctgaccttcattgctattttccgtgaagtctgctcatatagcaggtgacatgttcagatggccattttct

SEQ ID NO: 101265 - DNA, 177 bp, Homo sapiens
agaaaatgctgagataggagctgccaatggaccaagagaaaaattgacagtgtgccgaggccttcctcctgtgacataacttcagcatgcagaagagggcgatggtgtgtgtggctctctttggagaagaagcaagtgcatttgtctttgtcgttcggatggctggattcataacag

SEQ ID NO: 101266 - DNA, 304 bp, Homo sapiens
catgagtttttgatatggtttggctctgtgtccccatccaaatctcatcttgaattgtaatccccatgtgtcgggagaggggcctggtgggaggtgattgaataatgggggcagacttcccctgctattgtcatgatagtgagtgagttctcaggagatctggttgttcgaaactgtgtagcacttcccctttcacttgtactctctcatgatccacaatggtaatatgtgcttgcatccctgtcaccttccaccatggttgtaagttccctgagtcctcccattcatgcttccttgttaagcc

SEQ ID NO: 101267 - DNA, 407 bp, Homo sapiens
tgagacagtctcactcaggtgcccgggctggagtgcagtggcaagatctcagctcactgcaacctccacttcccgggttcaagcagttctcatgcctcagcctcccaaatagctgggattacaggtgtgcgccactgtgcctggcaaatttttgtattttcagtaaagacagggtctcaccatggtggctaggctggtctcaaattcctggccccaagtgatccacccgcctcggcctcccaaagtgcatgagacaccacacctagccaaattttccagtttctatagaattgtgtaaatatactaataaagcaggaatataacacacttaaggaatatatcacactttattagttaacttagaggcaatgggatgaaaggcagaccctgtaaaggtcatgagatgc

SEQ ID NO: 101268 - DNA, 1002 bp, Homo sapiens
ccaggttcaagtgattctcctgcctcagcctcctgagtagctgggattacaggcgcttgccaccacgcctggctaatttgtttgtaattttagtagaggcagggtttcaccacgttagccaggctggtctcgaactcctgacctcaggtgatctgcacgccttgacctcccaaagtgctgggattacgggcgtgagtccccacgctcagccactgtatcctttactcagtgtcatcaagttcaaagctctgaccaccctggtttctctgccaaagcctcatctacttccagctgggctttgaacttgtggtttttaagtgctggtttctctgctgcttttggaaaatagtgaccatcatgctggaatgtgctgacgcagactgggtgctggaagagacaagctccctctttgctctcattggccaaagatgttgctaataaccctgtgatctaggcttccttctaggatgatagcctctgacaggcaccatgccaggaggaaactagagcgtctttatcactgaaagatagcacgtttctagccacaggttctgaagttgatgtgaggttaaaatccaagaacctttgatagttttcagccaagatagtaatcagaaagtagatgaacgcagagactggggttgggacacgtggtcgggatccggggagggctctttcctaagctctgcagttagaatcctgtgaaggacgcagctgatagagtacaacggctttcgggatgtcggagattccccataggcaccctcaatgagcccatgaggtgagagacacctattggggcttagggaaactcccatagggggggggtagcgagggcgatgaacccaagcaccagggggccgggtacaatctagccacattgcaaacgacagaagaaggcacactggggggcatggtacacccgaaagcaggccgccggacaacaaaaaagaggacgaaggagaggaaatggtaagacgggggacccaggagcaccagcaa

SEQ ID NO: 101269 - DNA, 402 bp, Homo sapiens
cctgcttataattccaacactttgggaggtcaaggtggaagaatcaaatctccttgggtgttgtggtacatgtctgcagtccaagctacttgggtggctaaggtgggacgattatttgagcccaggaggttaaggctacagtgagctgtgatatgccactgcacttcagtctgagcaagaaagcataactttgtctcaacaaaaatgaacaataccacaggaaagacagaaccagaaaaaaaagaagcaaacttaaaatggacagaaaactacaaatgtacaatagtaactgcttacctatcactaccttacaaataaaaagattaaagtatctactaaacagatactgctgtacactgaatgtcatctccaaaatttaggataaaatttaatagccaacat

SEQ ID NO: 101270 - DNA, 379 bp, Homo sapiens
tggtgagggcctacttccctattcatagatagtaccttctctctatgtccttacatggtggaagggacaaggtagctctctggggcctcttggataaagtcaacaatcccagtcatgagagctatgccctcatgatctaatcacctctaaatgccaccacctccaaataccattatactggtgattaggtttcaacatatgaatttgggaagggcacaaacattcagatcatagcaatatgtatgtgatgtccaagcgtggtgccaggaacatagcaggagctcagtaaatcagtaaacagtagctataagataagtgagggaatggaacagggagttgggaaagtttattctcatatgcttcctggctttttgcagtt

SEQ ID NO: 101271 - DNA, 461 bp, Homo sapiens
tcttcttcttcgcctttctttccccctgttgaataccttctgtgtttctggaatttcagaaacatatactgccaaacttctactgtcccatcttccagaaaggggtaaagggaagagtcaagaaacaggccagagctagagttcattccttctgtcatgtgaggatgagactacaactcagacctcctgatacccatacttggaggatctccctactcccacatgagttgttctcctaattgtgttaggaataatcacagccacaaacggatgatatcagaggtgtcaaacagtaaggcaggagcatctctcagaggaaaacattcactgaacctgcctagcagagctagtttatgtcatgtatcacaccattaagctttggagcaggaagggccctcagagattacctagctcaatacccttgaggaaagggtgaactgaaacccagaaagaagagactt

SEQ ID NO: 101272 - DNA, 420 bp, Homo sapiens
  misc_feature (386)..(386): n is a, c, g, or t
accacccagatcaataaactgactcatctgatcttatggccccaaccggggaactgactcagcgcaagaggacagcttccactccctatgatttcatctccaacatgaccaatcagcactccccactttccgaccccctacccaccaaattattcttagaaacccctgatccccctacagggagattgatttgagtaataataaaactatggtctcctgcacagccggctctgggtgaattcttgcttctctattatagttcccttgtcttgataaatcggctctgtctagacagctggcaaggtgaatcccttgggtggttacaaattcacataaaaactacctcagaggagtgtcaaaggttgagcctaaacaatagacatcgnacccagatgaccaatacaaaggtgttaaattatt

SEQ ID NO: 101273 - DNA, 344 bp, Homo sapiens
catactcatcataaagatctttacctttattatttatagctgcatattgttttactgtatggatacaggtttatgtaatcgaattaaaacaaaaacctgccgggcatggtgactcacgcctgtaatcccagcactttgtgaagccgaggcaggtgtatcacctgaggtcaggagttcaagaccagcctggccaacatggcgaaacctcgtctctactaaaaatacaaaaattagctgggcgtggtggcatgcacctgtaatcccagctactcaggaggctgaggcaggagaatcacttgaacccgggaggtggaggttgcagtgagccaagatcgtgccactgc

SEQ ID NO: 101274 - DNA, 352 bp, Homo sapiens
atcttgcatctgcctacaccatccagcaaccatctgaaccttcaccttcctgatcttgcatctgcctacaccatccagcaaccatcggaaccttcaccctcctgatcttgcatctgcctataccatccaacaaccatctgaaccttcaccctcctgattttgcatctgcctacaccatccagcaaccatcggaaccttcaccctcctgatcttgcatctgcctacaccatccagcaaccatctgaaccttcgccctctggaggacccttctcagagccctcgtgtccaccctgttatgtgggcctccatctctgcagactcataagctggggccaggaaagggttccctccc

SEQ ID NO: 101275 - DNA, 154 bp, Homo sapiens
tcacacaagacccatcctttcctctctacgggctggcttctccccaccacccgccacaatacttcccagcataagtccctctgaaagttaacaaatattaaccagagagagattaattaactggttgacagtatttcaggatcctgcgtgagag

SEQ ID NO: 101276 - DNA, 357 bp, Homo sapiens
tctatgtaaattaactgcaaacatttgagtttgcaacccccagttttagccattaaattgttctaactcttgttatcaaagacaattgttttggctgggcgcggtggtgcacgcctgtaatccaaacactttgggaggccgaggcggatggatcacttgagctcaggacttggagaccagcctggacaacatgttgaaaccttgtctctactaaaaatacaaaaatcagccaggcatgttggtgtgcaactgtggtcccacctacttaggaggctaaggtgggaggattgcttgagcctcgggggcagaggtagcagtgagctgagatggtgccactgcactccagcttgggcaaca

SEQ ID NO: 101277 - DNA, 340 bp, Homo sapiens
aatttcttagttcactgcctgacatgtaataagaatatacggtcaatgagtgttagatttgatgatggtggtgatgatgacgattatctttaattatttggttcttcatggagcttagactttagtagagacatcacataagtttccatggagctattgaaggtctttaagtagattaatgactaggttgtgatgacctttgatgcctcctttttcacatctccccatctacaactagactctacaactagttgagttgtccttgatacgtcttatagatcaatcctttcttctccaataccactgagaatccccccattcatctaaaatgtaatgttta

SEQ ID NO: 101278 - DNA, 347 bp, Homo sapiens
ccttctctactcaacccatccaaaccctgtaagtgaagtgtaaagaatgcaacacagatcttcacaaagactacctaccaaaacaaaccccaaccagaaaagcattggggttactatgcaaagggatccctcagggataaaacaggaagaggggctcactgcatttcctctcaagggctcctgcttcaaccccacctatgtatcacaattcttttcctcttcagtattaaccccctacctcattaatttcctccactccaaccagtgggcagcaatgtccaacagagcacaatacatttaaaactgtttagaatggttgtcttgcacttttctcaccttgtcttctt

SEQ ID NO: 101279 - DNA, 401 bp, Homo sapiens
tggcaagcatgttctagtatttgcatggctcctagccctcatctccatttctctgcacagatgttaccttccccatgaggtctgccttatacatgaggcctgtattacaaactgcaactccccattccccaaccccgttgtttcttctctccagaacactaggcaccatctgatctactatgccttttccttattgtcctaatgtattgctggtcttcttcaccaaaatgtcagctccctgaggccagagatttgtgtctgttctgtccactgctatatgcccagcacctagaacagtgcctggcccagtgaagagtgaataaatgaactggacccagggaagaaacagacttgcccccaggccactcagagagtgagctgtgcccatacccgctcctggg

SEQ ID NO: 101280 - DNA, 400 bp, Homo sapiens
attttatttctttttaaggctgtgggtcatcttattgctgcagtcctaaaggaaaatggtttttcagaaaagattcaccaatctacaaatcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccagaaatacacatggcttgataaaagccattatgcacttactacaaatgcaagctcttaaggaaggacaaggtggggaaaagaatattcagagtatatataccattagaaatcatcctcatcctttgataactgtgcttgacacagacctgattt

SEQ ID NO: 101281 - DNA, 365 bp, Homo sapiens
tttttggagatagagtctcactctgttgccgaggctggagtacagtggtgcccatctcagctcactgcaacctccacccacccccaggttcaagcaattcttgtgtctcagcctcctgagtagctgggattacaggcacccaccaccacacctggataatttttgtacttttagtagagaccgggtttcgccatgttggccaggttgatctcaaactcctgacctcaggtgatccgcccgccttggcctcccaaagtggtgggattacagatgtgagccactgcacctggcctagtccattcatcttaaccactatgttagaaaagaaagcaaactcctggtgagaaaatattgcggccttcttt

SEQ ID NO: 101282 - DNA, 171 bp, Homo sapiens
gctgtgcaagatgcttttgcgtgtctatggtgctgctgatcaggcttgatctccttatgggttctagatatttctttttcatcagaactctctgccctgtgttacattcactcaaagcttcaggatgatgtcatggatcctgcttaagaaacttcagaaataaaagcccat

SEQ ID NO: 101283 - DNA, 757 bp, Homo sapiens
gtattcttagtagagaagaggtttcaccatgttggccaggctggtctcaaactcctgacctcaggtgatccacctgcctcagcctcccaaagtgctgggattacaggcatgagccactgcacccggccgaaaacattaagagtaggtggatgttactttggacaccaaatgaagaagtgtgccgagctgaaagagaaaaggagaagaaaatggacatgacatttacggggttcctcttgcagagagagaaccgtgtagaaggtccacacccgccgtatcctactgcacggtgctggaaggcacatggaagactattgcagcccaatcttctcatgacaaagacaggaaaatggagccctctaagagaaagtgactgatccacccttatgctcttaaatggaatgaggcagcaagaggccagattctgccggagacagagcagagagccaaaccatcgccacttattggtgcatgaacctgggcaaggcaggggtatccctgagcctcagcttccttgtttgcaaaatggtgacatgcctacttccagagctgttgttaggttaatgatgacgcagtttaccatatgccaggcacatagtaggcactaaatagttgcaattattagccctgagcaaacattgctcagccattcccttgtaaagcctattctcaaaccaactttccatgtggacgttcaatcatctttctggatgacctcgccttacccattgcctcagattctgtgtgtgtgtgtgta

SEQ ID NO: 101284 - DNA, 614 bp, Homo sapiens
agttccaacccctttgcggggtccaagggctcctggaggaggagatgacttctggggcacagcaaaccaagatgtgtgctccccagagctgacttggaagctgtccggcccctctgcattcaccccagctgcccatgtacaccaggcagcaggagggacagccactgcaggctgccagcctgtcctttgctgtctgtgtctgtgtcaagagtgaatgaagtgataaaaccaggagagcagtgtgctgtgaaaaagttaaagcctgacccaagctcagacagaggaagcaggagccacctgaacaactgaagggtgcagacacccagaagctggttttgtaaataaatcgtgcaccttggcgctggtgcactaattggaaaaaaaaaaaaaaaaaaaaaaaaaaaaaaaaaaaaaaaaaaaaaaaaaaaaaaaaaaaaccgggggaattattatattggggggggggaaaaaaggggtagaaaaaggggaaagtgtggaaaaaagggtggtttgagggcacacgtttttttggtacaaagggggaaaaatgaggggggctccctattaagaggaggagaaaaaagggggaaaaaagaaggaataactgatttaga

SEQ ID NO: 101285 - DNA, 449 bp, Homo sapiens
cgcagcctccgcctcccaggttcaagcaattctcctgtctcagcctcccaagtagctgggactacaggtgcatgccaccactcccggctaattttttgtatttttagtagagatagggtttcaccatattggtcaggctggtctcaaactcctgacctcaggtgatccacccgccttggcctcccaaagtgttgggattacaggcatgagccaccacgcccagctgatagcttatctttacaggtacagggcaaaggacagagcttatctttacaggtacaggacaaaggacagaactcaaagtcatccctctgctcccctgagacaaatgcatatgtaattgcttcctctccgctatatttatgtaatctcatgtaaaaatgcaggttgaagggaattctctggggctttggggaatttagtgcgtgagagagggaatgatggggatc

SEQ ID NO: 101286 - DNA, 270 bp, Homo sapiens
cagctagagttgagttgtaggatggtttctgtgaaactatgtgttcataattcaaaacaaatttattacctggcatttttgcactgaatgtgtttaaagagttaattgatcagtgttagccttctgaaagatgtcatcgttttttattttttcttttcgaaaaagagtcttgctctgttgcccagactggagtgcagtggcatgatttcaactcactgcaacctccgcctcctgggttcaagcgcttctcgtgcctcagcctcctgagta

SEQ ID NO: 101287 - DNA, 882 bp, Homo sapiens
ggaggtggtgtcagtgaacttaaggtcagtcttctccagagcccatcgtctggtctgcaccagcaaagatgtgcagagaatgagcactcgcttcttggttcccaccacacagcctttcagcataacagagttattggtcacttcaccatagtggacaaagccacccagaaggtcgatgctcttgtcagacaggtcatagtccgtggaggcattgttcttgatcggtttgctgtcctcagtaaggtagccctggtcaatcttacagatcttcttgttgatctcagtgtggtgatggtcgcctttctgcccagcacatgccatggagaaggccacatggtcaggatgccatgccccaatccaggccaccttgcacaggcctcggtgggtcttgtggggcagcttcttggtgtgccaacaactggtgacccctttgtagcctttgcccttggtcaccccgatgatgtcgatcatctcgtccagcccaaacgcttggttcacaggtacctgctgctgtagcccctcctgggctcagtccagcttctcagccatggtgcctccgttcacttggatctccatcagctgggccttcttctggcgcagaggaagtaggcgcgtctgggtgtgggcagcgaggtgggtgacttggcagtgcttcctcatgctgctgaagtcttctccagctgcttcttgccatcctcatcctgccatttcttgcagtacttggtaaaggccttcttcctagatttatgccggttgttagagaaacaccttttgcactcatcgttgatgtgctcagcaaagatggccttgaaggtccggaggcctcaaggggtttccacgtagcccgcaatgcccacaaccaccataggtggtgtctccaca

SEQ ID NO: 101288 - DNA, 464 bp, Homo sapiens
ccaatgatcacagcacacgttgagcctgccgagagtctctcttggggcaagacatctagaagtgctagggaacgcagtcccacaattccaataaccaactgcagacagaactatatagatgagtatcacgcttaggtttcccacgcccacccccatctgtgaagtcaaacagcctgttgtcaataccagaagagacaagtttgtacatcacaaaagacaagcaagtccccaatctaattatgccagccactttagaaggagagcaaagacagcagacactctgggcaatgaattaccctaagtctcagcatcaagcctgcactcatctcctgggtccccaaataactcaccactggtcagaaggatggatgggcccttccaaatcacagcctgggctgtctgaggacagctctcccaggaatcatctctacccacctaggacgtgagtggagtcaataaataag

SEQ ID NO: 101289 - DNA, 886 bp, Homo sapiens
atctcaaatgagataatatcaataaagacctcctgtcgtctctacccaagaaataaactaaaggaaggcagtgtccttgcaggcattttgacatcagggatgggcaaaaacatacatccatttaagaattctagaatcagagactaggaagagttgaaacaaccttacagatcacttgatgcactttatatagacccaggggagaaacaaaaagaccaactactaaagctgctaaaacaagataaagcatactgcaagggaaaggctggagcagttcactggctgaagttataaactccatcaagagacacacaatcagatggcacaactgtcttcagtgggtcacagttttccaaatacaaaggcggtgcctaccgaagctctgggattctggaaaatatactggacttggagtaagacaatctcagtccatgttcctagttctaggattttacggcataacacttggcttttagggcattgtattttctttatagtaacatggtattaaaatgatgcctatcaacaggcttgtcaggatgagtcaacagcatattagatgggaaaacaccataaagtacaaaaggcttgttatcgtcagtctcctttggttgttatatcggttaagaggactaattgtttgcctctctccaagttcagaactaattcaacatgcatagaggagtcagaaggtgggatccaaacatttatgtttatttacctagtttaacgttcggcatcataaggaacttggcttgaacttataagcttcccaactggtatctataacacaactattgttctcttatcctgccctttctccttgattatactaataagcttgggaaagaagaaattcatgacaaaagcataccttggaactcct

SEQ ID NO: 101290 - DNA, 783 bp, Homo sapiens
atctcaaatgagataatatcaataaagacctcctgtcgtctctacccaagaaataaactaaaggaaggcagtgtccttgcaggcattttgacatcagggatgggcaaaaacatacatccatttaagaattctagaatcagagactaggaagagttgaaacaaccttacagatcacttgatgcactttatatagacccaggggagaaacaaaaagaccaactactaaagctgctaaaacaagataaagcatactgcaagggaaaggctggagcagttcactggctgaagttataaactccatcaagagacacacaatcagatggcacaactgtcttcagtgggtcacagttttccaaatacaaaggcggtgcctaccgaagctctgggattctggaaaatatactggacttggagacaaatcagaataaaacaattcaactttcaaggtattaaaaggattcaccaactcctatctcttaacacaatggccaaaaaactgctggactcaaggcacagtcatgtattcctggcataaggcctgcctgggtgttctaactcaatgagccccacatgccagactatttccacagagctgatatgggacaggaagggctaaggaacttcaaaactaatagtttggtgcaactgatatggacctgtgcagtcactgaccacatgtagcactgagaacttgaaatgttgcaagtgtgactgaggaagtgaattattaaaacttatttttaactaaatttaaaaggtgatagctaattcagtcactagaaa

SEQ ID NO: 101291 - DNA, 461 bp, Homo sapiens
cataatgttttcatcttccccaacagaaattctgtacctattaaacactaactccctgatcccctcttcccctagcccttggcagccaccattctattttctgtctcttatgaattttgctactcttagtgcctcatataaatggaatcatgcaaaatatgtcctttcgtatctggcttatttcacttggcttaatatcttcaaggttcatccatgttgtaccatttgtcaaaatttccttcctttttaaggctgaaatatttcattgcatatatataacacattttgtttacccattcatccactgatggacatttgagttgtttccatgttttagctattgtgaataatgctgctatgaatattggtgtacaaatatcttgatattggtgaattctacaatatgtaaaatatacctcaatatagttattttaaaataaaacatcaattctaaaaaatta

SEQ ID NO: 101292 - DNA, 342 bp, Homo sapiens
ggcgggcactctactctgctagctctcgtggatttagcgtgatagtaataaatccattctcacactgctataaagaactacctgagactgggtaatcttttagaagaagaaaggtttaatcagaggcctcaggaaacttacaatcatggcagaaggccaagggaaagcaagcacgtccccgcggcaggagtaggaggaagagagagagcaaagaggggaggtgctacacacttatatacaagcagatctcaggagaactctttcgcgagacagctctagggtgatagtgctaaaaccattacaaaccactcccatgatccaatcacctcctaccaagcccct

SEQ ID NO: 101293 - DNA, 346 bp, Homo sapiens
ggagagatgcttctagcggacaacacaattatggtttcatcgacttagaagatgaggctaccatatggctgtttggggctccttgtaccactgcagcaatgtgcagaggagggggtgaccttgctggcagaagggactgatcctgattaccaaggggaaagtgggatgctgcacagggaggcaagcaggactatgtctagagcccaggagattctcgggagggctttagtgccaccatgtccagtggtaaaggcaaggggaagtacagcaaccaaaaacactgcaactccaaaaaatgacagcactgtggaaaattcagacccttcaggaacgaaggcttgggtca

SEQ ID NO: 101294 - DNA, 183 bp, Homo sapiens
catttcctactttttttttttacatcaagctgcactaagacaaccatacatagtgaaactatcatcatctaatggcattttcattttaatttgagatcacagtttaagcaaaataagtgagagtattacataaattttttttttttttgagacagtcttgctctgtcacccagactggactga

SEQ ID NO: 101295 - DNA, 236 bp, Homo sapiens
aggccctttggcacaactgtcatcgatttttcatatgctgttcatgattggtgtccttgccccacactggaccccacattagactgtcagctctgtggggtgaggaccatgctggttgatgagccgagaagtagacgacatctgagatctgcctgaccagaccccattcacttgaggaactagccttccctctctcattctcaagccaggtgattcacaaggaaccaacccatctc

SEQ ID NO: 101296 - DNA, 791 bp, Homo sapiens
tgactgtgcactctgggacaggttccttaaccattctgagccttggtgtttttcatcttaatgatgtggctaagaactgtacctactccatagggtgactgtgggctttaaatgaatttatccccacaaaacacttaccatgtccctggcacactgtaagagatcaataaatgttagtatttgtgatttaggggtccagagctggagctgtagagtgccccattgggtcagcaggccagctctctggacacagggacaattgtcgtattgcagacctagagaagagggcagtatttcttccaaggaccttgcctgaagggcctgttcaccagttggaagaatcatgtagggaagagagctctgagctgggagtcctgggttctagtccagatcctgccactcactcactgcctgagtggccatccctttctgaacctgtacttctgcatcccccactgtgccctccacggcctttgctgtgaggaaccagtaaggtaacatatgtcaaagtgctgagagattgttattagcaagtcacaaagatttgtataagagagatttacttttctttccctcacggaatttgagcctgactgtctacccagggcactgttcagggtggaatctcatggtctgtggaagggaaacaacttttctctgctctaatcccataacccaaggacagaataccttatgcatcccctcttggggatctctgctcaacttctcttgcttccctgacgctccccgccccctggctatatcgtgcccttgtaatcctggcccagaga

SEQ ID NO: 101297 - DNA, 196 bp, Homo sapiens
tgggggacgacgtatgcaacttactctcaaataatttggcaaaaaatgcagtagtaaagcaaatgtgactagaagaaatgttaacaattggtgaatctgagtaaagggtaagaaaattgtacaatttttgcattttttataagattaaagttatttcttttttttattcttgttttcttgagatggagtctcgctc

SEQ ID NO: 101298 - DNA, 276 bp, Homo sapiens
aaaatttgctatccccttcacagtgtgggagctgtcactgggaagtggttgcccagtcaaaattttccctttccaagcctttccaaccttgtatcacatgtggccttgtgagtagttctccccaatagaatgtcagtgagaatgactgaatgccaacttccaggttaaggttcctcagaagcagcaggtaaggtatgttcatgctctttccccagctgctagaggactccaaggcccacattatggaaggtcaccaaatgatcaagaatgccttca

SEQ ID NO: 101299 - DNA, 722 bp, Homo sapiens
actaccctaaactctgttttatttatttatttatttttatgttttcagttttttttgagacagagttttgcttttgtcacccaggctggagtgcagtggcgtgatctcagctcactgcaacctctgcctcccgggttcaagcaattctcctgcctcagcctcccaagtagctgggattacaggcacatgtaccaccacgcctgggtaatttttgtattcttagtagagacagggtttcactatgttgaccaggctggtcttgaactcctggcttcaagtgatccatccacctctgccttccaaagtgctgggattactggcgtgagccatggctcccggctcctaaactctgttttaaagatgtcttgcagaaatagacatgaagaaatccatgagaaatacaagagcagatgatacaaagttgggcaaagaaataagtaaaaattatgatgtcataacctgttgatttaaaaaatagtggtaagaatattaacgctgtgaaacaaaacgcctagaggactgggttgggaggggccagggagcacattgccgttccatcctatctggggaggaatatagatgcttgtcagtgggcattttgatagaaaatatctaagtatatatgctaacaattcaagagtctccttaagaataaaaatagcatgtatatacctgaaaaaaaatatgacaaatctttattttgggcatggtggctcaaactt

SEQ ID NO: 101300 - DNA, 261 bp, Homo sapiens
tatttgtttatgttttaatttcaacttttatcatagattaaagggtacacatgcaggtttattacatgggtaaattgcatcaccctgaggcttgggatcccaatgatcccatcacccagggaataagtataggacgcaacaggtggcactccagcccatgccccctgctcccttccttccccatctagtgatccccagtgcctattgttcccatcttcgtgatcatgtgtcttcaacgtttaggccccacttacaagtgat

SEQ ID NO: 101301 - DNA, 304 bp, Homo sapiens
caggctcattttaggagaactcagtttccaacacgtacaagtgaagggagagacatttccttaacgtgacaaagatgcatccagcctgcaatcacccagaccagggggcccgctgctgcagccacaacaacgctgcttcccgccaccaaactgacgattatcgcaacctaacaaatcacattaacatcctttcgtataaatgagctggtattaactgaagtaatattgatattttggtgcaaattacactttcacattaaaaacagaagaaaatttcatcaaaagtcgacttattcaaatgaac

SEQ ID NO: 101302 - DNA, 241 bp, Homo sapiens
cacagattttttttttttatatggcagtgtggagagggagaagaactcgtttggctggaacaaaggtctgtgccgtggagtggggtgggcaagatgcatggagaggctggaaggccagcttagaaaagccgaaatctggccgggcacagtggctcatgcctgtaatcccagcactttgggaggctgaagcaggtggatcacctgaggtcaggagttcaagacgggcctggccaacatggca

SEQ ID NO: 101303 - DNA, 405 bp, Homo sapiens
ggctcagtttccggttcttgaactagactttcctactgagtgtcacatgaaaaaaaacaaacaaaaaagactgaggcacagggacaaaggaaagagtatttagctggcacactctcaccttagttctccatctaccttaaaatgtcccgggggcagagggtgcttgttacaatgaggattctcggtccacaccctagatctgtggactcagaatctttggagggaaactcaggaatcagcctgtaaacaaatatccaagatgattttcgtggcccacctgggatccaaccatatgcccccaagaagcaagatccctgccccagttagagaacctacttttttccccagattccatttctcttgtattcattcttgccttgtttcttcattagcatttcatgttaa

SEQ ID NO: 101304 - DNA, 1401 bp, Homo sapiens
attccgtttccggccgttcccacccctgttttcggtcggcccgggtgttctgcaagctggtcaaaaaggggaagcggcccagatatgttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggatgatagtggactgtgtttccagtcatctcaaaaaaacaggagatggtgcaaaaacatttattatctttctttgccatttgcttagaggacttcatgcaatcacagacagagaaaaggatcctttgatgtgtgaaaacattcaaacccatggaaggcattggaaaaattgttctcggtggaaatttatttcccaggctctcctaacgtttcagacacaaatattagacggtattatggaccagtacctaagtagacactttttgtctatcttttcgtctgctaaagagagaacattgtgtaggagctctttagagttgctcttagaagcatacttttgtggaagagtgggaagaaataatcataaatttatttcacagttgatgtgtgactactttttcaagtgtatgacttgtaaaagtgggattggtgtatttgagttagtggatgaccattttgtagagttgaatgttggtgtcactggccttcctgtttcagattccaggatcatagctggtcttgtgcttcagaaagatttttctgtgtaccgcccagcagatggtgacatgcgaatggtgatagtaacagaaaccattcagcctcttttttccacttctggatcagagtttattctaaattcagaagcacagtttcagacatctcaattttggattatggaaaagacaaaagcaataatgaaacatctacatagtcagaatgtaaaattgctcatatctagtgtgaaacaaccagatttagttagttattatgcaggggtgaatggcatatcagtggttgagtgtttatcatcagaagaagtttctcttatccggaggatcattggtctttctccatttgtaccaccacaggccttttcgcagtgtgaaatacctaacactgctttggtgaaattttgtaaacctcttatccttagatccaaaagatatgttcatctaggcttgataagcacatgtgcatttataccacactctatagttctttgtggaccagtgcatggtctcattgaacaacatgaggatgctttacatggagcacttaaaatgcttcggcaattatttaaagaccttgatctaaattacatgacacaaaccaatgaccaa

SEQ ID NO: 101305 - DNA, 750 bp, Homo sapiens
acccctgttttcggtcggcccgggtgttctgcaagctggtcaaaaaggggaagcggcccagatatgttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggtacccgcgtcccacacgctaacccgtagccgggcaccccaggcagcctctgtggagctcttgtcccatcctgaggcgatgcgtacttagaaagactgacctcgggtgaaaccgctgtatgctcggaattagagccctgcccaagggaacactcctgcaccccaaatcttaccaattctcaagaccacttctccccactccacccaacggtggaatcttggaatagagcagagttttttccaagaaaggaaaaaactaaggatgtatccaaggaacaatattctcattttatgcttatggctgtgtaaacatggttttaagatgtgggaagccagccttctgaaaatgagttgctttatttcttttttgtacaggatgatagtggactgtgtttccagtcatctcaaaaaaacaggagatggtgcaaaaacatttattatctttctttgccatttgcttagaggacttcatgcaatcacagacagagaaa

SEQ ID NO: 101306 - DNA, 1429 bp, Homo sapiens
  misc_feature (22)..(22): n is a, c, g, or t
  misc_feature (35)..(35): n is a, c, g, or t
gcgatctttgggttcaaccatnattgaaaaccccncgtggtggtttattacacagctgtcggcgaatccggatgggtgtctgccaagcttgttcaaaaggaacggcccagatatgttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggatgatagtggactgtgtttccagtcatctcaaaaaaacaggagatggtgcaaaaacatttattatctttctttgccatttgcttagaggacttcatgcaatcacagacagagaaaaggatcctttgatgtgtgaaaacattcaaacccatggaaggcattggaaaaattgttctcggtggaaatttatttcccaggctctcctaacgtttcagacacaaatattagacggtattatggaccagtacctaagtagacactttttgtctatcttttcgtctgctaaagagagaacattgtgtaggagctctttagagttgctcttagaagcatacttttgtggaagagtgggaagaaataatcataaatttatttcacagttgatgtgtgactactttttcaagtgtatgacttgtaaaagtgggattggtgtatttgagttagtggatgaccattttgtagagttgaatgttggtgtcactggccttcctgtttcagattccaggatcatagctggtcttgtgcttcagaaagatttttctgtgtaccgcccagcagatggtgacatgcgaatggtgatagtaacagaaaccattcagcctcttttttccacttctggatcagagtttattctaaattcagaagcacagtttcagacatctcaattttggattatggaaaagacaaaagcaataatgaaacatctacatagtcagaatgtaaaattgctcatatctagtgtgaaacaaccagatttagttagttattatgcaggggtgaatggcatatcagtggttgagtgtttatcatcagaagaagtttctcttatccggaggatcattggtctttctccatttgtaccaccacaggccttttcgcagtgtgaaatacctaacactgctttggtgaaattttgtaaacctcttatccttagatccaaaagatatgttcatctaggcttgataagcacatgtgcatttataccacactctatagttctttgtggaccagtgcatggtctcattgaacaacatgaggatgctttacatggagcacttaaaatgcttcggcaattatttaaagaccttgatctaaattacatgacacaaaccaatgaccaa

SEQ ID NO: 101307 - DNA, 349 bp, Homo sapiens
tccaaacacactaactttttattcaatttgattcaaaataataatattaatctaatagtgaaatagtgatataacatcaatcaacatttagagtattttatgtttcaaagtatggctcaggaacacccattgctaaatgcacttagacataacaagacagtattttttattggcatcattgacacctatgaacaatagcctagtaaatagattaaggtttaaccttccttttctttggtggctgtttagagactttaaaagaacagataactcatttcaacaggaatctactactgatatttacctctacataatctttagctaagacttggaatgccaaaaacaagct

SEQ ID NO: 101308 - DNA, 727 bp, Homo sapiens
gcagaataagggacatgaggtgcaagggagacagcctggagggtcggcagggtggctgtcgggtaccagcaggccacacagggccttgtgggttggagaacagatgagccaatttatgcctgtttttctggcataatcatggtaccgtctttactctcacaaaggaagaaaagttctggtttggatgataaattgcatggccatggagaggagtttagattttgttcttctagagatgggagccgctgaagggctgaggatggttcgtttgccatcaaatgcttaggttgtaagcttaggtgccttctggccttggggcagaagctgactgtgggtggcagtggacacggagcccgagggaaggctcctctgctccactggagacacgagggtggccccactttggggacggggtggacatgcggagaggattctgacggcggagcggcaggatttcctggtggactgggcgtggagctgaatggaagacggggcacaaaggaccacagggtttttggccaaagctgcaggaaagaggaaactgacatcagctgagacggggaagatggggagggggcagggaggagccacagttctgctttggatacacaagttgtagatggccttcagatatccaaggggaggcgtccaggaggtagttgggtttccaagtctggggttggaggggcaggtccaggctgcctgagggtaggggtagcatttaagg

SEQ ID NO: 101309 - DNA, 236 bp, Homo sapiens
tgtctcaaaaaaaaaaaaaaggaaaaaagaacaattgcctagatgtggagtctacagcctcaaagatacaggatattcaaggaaattcagataattacaaacctaaaaggttagaaaaaacaaaacttaagaaactacttacagggtgcagtgcaccagcatggcacatgtatacatatgtaactaacctgcacattgtgcacatgtaccctaaaacttaaagtataataataaaa

SEQ ID NO: 101310 - DNA, 835 bp, Homo sapiens
agcagttggcccttagatcatgagaccagcctaagtgcccaaggaaatggaacagcagggagggggagggacatcacatccactatcaaaacttcttgttagtctctggcttccacatcctttcccaaaacttcagcccaattcacagccgcatttttccatctctttgccattcctccatgggagagctttctgttggtacaggaatagctgagaagtgggaaagatcaagggtagtaagagctgcccccgataatctacagaaagctttgctggaatgaggttgtgcatctctgaacctgagctagatttgttgggtcagggaccatacttatttactggcccaagaattagaagaggaggtgtctaagaaatgcttgttgaatgaataaataaacagccgagtgagtgtttatatgagcctgaaaactgcctgcaccagcacaaaagtaaagccccaacaccctcaggtcacacctactggaaaaatatatgtcagccccagaaaaatgtgggcaacatgaggcaactccggagcaacacaggaaactgccctcctcttctggcccctcttccactgtgatgctcaaagtctgtgatgaccaagtctggtcatctaatcagcaggatataagagggtcattcttcactgcggccattccagtttcctggaaacttggctttctcctgaccgtttccccatgagcacggtggtgacaagcttgagctctgacatcagaaagtccccagtttgaaacctctagcttcttactcgctagctatgagactttgggcaaattaatctctaaacctcaatttctcaatctgtaaaatg

SEQ ID NO: 101311 - DNA, 265 bp, Homo sapiens
aaaatgcataggaccatctagatttgcagcagtaagattccctatccaggcatactcaagtccccaggctcacgcctttaataacaagaaactgtacgtcaagaccgattcatgtgaggaggtattcacttaaatctttagacttactattgtaagagtggggtcagttatttgaaagatgtgggtatttacaatgctaaggacagagtaaaggcaaaattaaaaaggtcagaaatcacttttctggtgaggctgagacatcatg

SEQ ID NO: 101312 - DNA, 670 bp, Homo sapiens
ctttgcccttctgcatttttgattcttttgtgaaccctcttgcacacttgcttttgcacacgcgcccccccccccagcattttcagtgctctccggaagccttgtttctcccctttaataatgttcttgcgcaccatgacatggctgcacaccgcatcttgtcttttctacctggatgagagctctaccacttctttccttttgcacactcatctcattccatgcactcttgggctgtaactgtcatttcttttcctgacacgcttattttttattcctgttgacaagcagctcttgcggccattctcattcggattctcttacctccttaagctctttctcttcctggtgagagaagaccctatgcacactggcttcctgctcaccatgcttccacactcgagcctctccctgcctccagccctcacccttcctcacatcctccctcttctgtctttcctgggccatctgtccatcccttttgcacgaagattgccctctcctaacctgtccactccaagaagctccctctccctccagcatggctgttccttcccgcacgcttcctctctccgcttattcccggggcttgggaatgttaagccacccctccccctgaaaagccccctcccctgctgtgggtaaaggggggagggcgttgccctcaggt

SEQ ID NO: 101313 - DNA, 455 bp, Homo sapiens
tcagggcacaaaagatcatttatttttccaattgtgaagtgaacattagataaaattatttcatttcagattttttgaaaaggtaaaaataataaggaaaataccctctcgaaaaggctttttatttcgtttactgaaagcttccaataacgtgcctagttttaaactaggttactgttatttatcacataatcatccccacaggtttgatcaccactaatttgcagatgcggaaactgacaagctcagagaggctctcggttgccttttgggaagtggccaaggcgcgatttgaatccaggtctcttacctccagtttctgagacctttctagacaccaaggttatctcttcaaatactgctgcaagtaaacagctgtgtgagtatctagacttttgaagttagcagactctagggaataggtagaataaaatatatgggtatgtgttcgcggg

SEQ ID NO: 101314 - DNA, 265 bp, Homo sapiens
ctttagaatttttttttcttaaaaaggtaattcagggcatatatcatatattatcagagactccccagtaggacatagagcagcatcctgtgatcaaacatcttagtatttctgcagcaaaatgtcatgaatagtcacactaggtagaataaagattataaactgcttcatgttcgttcaagactggtttgcaacaaatagttcatgtcagaccagggtttttgccagaaaactgtgggcctagaacaagtagatggtacatcaa

SEQ ID NO: 101315 - DNA, 343 bp, Homo sapiens
tattatggttttagtgtctaggaccgtaaagtcatgacagtgactcctctcttcagccccagttcgtagcagagggcccggcgcagcccaaagcaggcacccggatgtttggtgaattaggggaagtttttcctgtcccggagccgtaatgtggtacttgtgattttccttgttggaaggcacagctatgtctgccaagaaagacaaggcatgtagtcaccatgctgctgcctcacacagacattttttaagccaggacttctggagaaggaagcagaaaggaaggcaacttgctctttggcccatggagtttcagcagttgcaggaagttggctggggtgtg

SEQ ID NO: 101316 - DNA, 400 bp, Homo sapiens
tatgcacatgaaagccacatccataatcattttattattgtgtctactccgtagggcatcacactagacactgggctacattaaagtctcaagtcacagtattaatcttcaagaggcttccggtttaactaaagcactggtaacaagcataaagaaacctgcacttgactaaatctggaacttcattagatgagccacagagaaagtgaacagcttctgtaaaccacaataattgggcaaaatggacattaaggctcaggccatagatttgatttttgaaaaacaaaatagattaaaaatctattcttggccaggcgtggtggctcacgcctggaatcccagcactttggggaggccgtagcaggcagatcatttgaggttaggagttgagacgagccta

SEQ ID NO: 101317 - DNA, 266 bp, Homo sapiens
tgtaagtcagatataaaacttgttgttaagtcagtactttttgaaataggtagactaagcatcattttatatttgttttcagggaacaagttcatttgataaagtgcatttgagctacttgtcattaagttttttttgttttttttttgtcgtttttttacttgtcattaagtttaaaaattactatgtttagtatttggtcaatttgatatcttaaattgttgaggattgcattttttaaatcactcacattgttcaattatcat

SEQ ID NO: 101318 - DNA, 556 bp, Homo sapiens
caactagtcttctaaattagaacttaaacacaatgaccagatatgaccctgcaacagagcatgcccttctgcattgagcatgcaatcatgaatcacaggctctactgaccaagaacaaatcacagactcagagagcatcataaaaaggcctagacccacgatgcccagagactccaggctcaacccacattgatgctggcccttcagccatgagactccatttgcttctccttattctccttcttttttcaattctcttatccccagaacagatgtctgcaacatagtagaagatcaaattggtgcctgccgaagaaggatgaagtgctgtagagcatggtggattttaatgccaattccaacaccacttatcatgtcagattatcaagaaccccttaaacctaacttgaaatgaaactgaaacaaaataaaaatacatcaaaagtgaagttatttgcatctaagaatattaaaatatacatattaagtacttccatcttgataaccgtcttgcattttcacttatcaacataaatgaataaatactaatttcaaa

SEQ ID NO: 101319 - DNA, 215 bp, Homo sapiens
ggagtccatggctgtgtgcattagcagtggcagtggcagtggtagcagtagcagtggcagtggtgacatgtggcagtggaagtagcagcggcagcggcataggcagtggcattagcagtggcagtggcagtggtagcagtagcagtggcagtggtgacagtggcagtggaagcagcggcagcggcaatggcaggtggcattagcagtggcagtgg

SEQ ID NO: 101320 - DNA, 888 bp, Homo sapiens
  misc_feature (549)..(549): n is a, c, g, or t
  misc_feature (686)..(686): n is a, c, g, or t
agccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggaagggcaccagctgaaacaactgctgctgaaggccctgactctgatgttggatgcagcagagagttatgccaaggactcctgtgtgtgacaggcccaacactgtcagcggctcaccaagtngataactctgcagattcactttctgaacactggccaaaacacaatgctcatcaacttggggccggcacaagctgatggactgtattctggccctaacctcggtctccaggcttctattgaggctgatgcctacgatnttggtccaaaattgggctgacattttataccacccagtgattcttaaaggagactttaataacttggaagaatttaagcagcaacaggtatttatagtcattatatttcgaaaaaactgcaataatataacacacatcacctactgactgtgtatgggaactatgagaaataccacatattgtgagaatgttacctggttac

SEQ ID NO: 101321 - DNA, 672 bp, Homo sapiens
aattgtacacaagaagaaatgaaaagaagtctgctaggaatccttgcagactaaaaggagatacatgagagagactttctttctgtctctggacattgtcatctgtctggagtacctagaactgcagcagtcttcatagaatcatgagagtaagcttttgtgttttagataaagtggcagatctgatttgttgatagcaattccctggagtgttgcattgagaagattctgaggccttggtctactatctgtgactgccatggaatcctgagtggagcgaaattaagttcccagacttgttataccctcctgacttgttctccccttccttgggaagggcatctgttccaggcaggtaacacctgtcatcctggctggtctagctgtgttctcgtcacccatgccggcacagtaccttacacgtaagaagagctcagaaattctttgctgaattcattcattttgaggcataaaatccaatcttcctgaagataagtcctttccactgaactggtggggtgtggggaaaggggttgctggtacttcatctggggaccccgaagggaccaggatatgagttggctagaaaaggggcaggtaagtatggggctttcccacccacagtagtcctgcttcatgttcttctttcacaattatttgacagggcacccc

SEQ ID NO: 101322 - DNA, 142 bp, Homo sapiens
atcctgggctcaagcaatcttcccccctcagccttccaagtagctgggactccatgtgcatgcccgcatgcctggatagtttttattttattttttctttgtagagacagggtcttgctatattgcctaggctgctctcgaa

SEQ ID NO: 101323 - DNA, 753 bp, Homo sapiens
tgaaagaatagttaacatttgaacaactgaattggaagctatgaacatggttttgttttaaaagagcttaaaatgtttcaacctccttaattaaacttaactttagacacaattattgataatagttctttagtataatacttcacatgcatttaacaattcgtttcttttccttcacagatggaggaattaaatcccaagcatcttctaactagggctagccattttgagaaacagtgtttttatttttgtttaatttgcattcagtttatgagatatacttcttgtcactgctgttaatcatttttattaagaaaatgcagcaaaatgcacaaataattatacagatactgttttttagataaacatgttgacagattggaactaaactttttgctggcaggcagtgttggtatatgtgaggaaatcagtttgccccctccggatgggtgctgtatttagattggcataaaattatttcttctagtcaggagaaaaatttcattatcttacatttactagttgtagtaagacatagaaagttgaatttaaagtagaatttatcccccaaaacaaagaaaaaattatgtacattcagatgatttttactgcataaaataaggaataatgaggttaacaaaaagttcgtgtgttagaaaataactattttcgtcactccaacatcatatgatcttagaatatttcttgttaatgtaatagcagataataaaaaaattaagcagaaaatttctg

SEQ ID NO: 101324 - DNA, 1221 bp, Homo sapiens
actggtcggcccacggggtaggcggggaggcggaagcgggcggcgctacggctgactgggaaatgtcagccgctggactgtagacggattttcctttctcgggagcccgcaggccttctggtgatcgccagcgctgtcgtctctgagcgtggatcccagaacctggacagctgtggcggccgccgtttcccggtcccgtccagacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccagatatggtccagacctgtacatgaataactttggttagtcagagtgaaatattcaataatgagtggtgcagctttgggacttgagattgtttttgtcttttttctggcattatttctacttcatcgatatggagactttaagaaacagcatagacttgtgattattggaacactgcttgcttggtatctctgctttcttattgtcttcatactgcctctggatgttagtacgacaatatacaaccggtgcaagcatgctgctgcaaattcaagccctcctgagaatagcaacattacaggattgtacgcaactgctaaccctgttccaaggtatttcctttttttaaaaaaatatataaacattgtaggggacacattgtttaaaaattgaaagtttttaccatccagactttatatttatgtaagttatcctcattctctactaattctccccacctctattctttcctagtagacttttcattacatcatattctaattaaatctaatttttaatatttattggtccacaaagcccttcagtagacggtagtgagaaacttgaagaagtcctgattttttagtcctggttcttctttaccaagtatgtaatttctaaaacctgtttttcctctcagcctatctcagatttaaaaacgtgggatgtattttcacttttgcctaatttacaaggttataataaagacaagtatttctgaacttatggtattcctttcatattgcacatccttcaaaagcattatagatttacataaaaaattaataaagttcaaattgtccaaagattatattgaattcatatcgaacttttaagta

SEQ ID NO: 101325 - DNA, 576 bp, Homo sapiens
agacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccaggtgagaggctgcgaactgctggcgtcgcacctgttcgtccttttgccaggaagcttcttcctccgtcggggagaaggcggccctaagaattgggtctgtggacgggatccttcctttatctgtaaaataacgcacaacagctaaacacgccgttggaacgagagacaatggtttaattttaggggagccggagaccccagcgggtcctgtgtggtgggaaggctgcgcatgcccttgcagccttgacaggtctcataaatagcaacatgggaataaatgaaaggactgtattttgcaacgagctttacccgtgcacgcagggggcctccagcaaagccatttggttgcttgctgtcgctcagctggctacgtgtgtttgcgtcgccgcctaa

SEQ ID NO: 101326 - DNA, 819 bp, Homo sapiens
actggtcggcccacggggtaggcggggaggcggaagcgggcggcgctacggctgactgggaaatgtcagccgctggactgtagacggattttcctttctcgggagcccgcaggccttctggtgatcgccagcgctgtcgtctctgagcgtggatcccagaacctggacagctgtggcggccgccgtttcccggtcccgtccagacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccagatatggtccagacctgtacatgaataactttggttagtcagagtgaaatattcaataatgagtggtgcagctttgggacttgagattgtttttgtcttttttctggcattatttctacttcatcgatatggagactttaagaaacagcatagacttgtgattattggaacactgcttgcttggtatctctgctttcttattgtcttcatactgcctctggatgttagtacgacaatatacaaccggtgcaagcatgctgctgcaaattcaagccctcctgagaatagcaacattacaggattgtacgcaactgctaaccctgttccaagccagcatccttgtttcaagccatggagttacattcctgatggaatcatgccaattttctggagggtagtgtattggacgtcacaatttttaacatggtaagttac

SEQ ID NO: 101327 - DNA, 1124 bp, Homo sapiens
actggtcggcccacggggtaggcggggaggcggaagcgggcggcgctacggctgactgggaaatgtcagccgctggactgtagacggattttcctttctcgggagcccgcaggccttctggtgatcgccagcgctgtcgtctctgagcgtggatcccagaacctggacagctgtggcggccgccgtttcccggtcccgtccagacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccagatatggtccagacctgtacatgaataactttggttagtcagagtgaaatattcaataatgagtggtgcagctttgggacttgagattgtttttgtcttttttctggcattatttctacttcatcgatatggagaacaatatacaaccggtgcaagcatgctgctgcaaattcaagccctcctgagaatagcaacattacaggattgtacgcaactgctaaccctgttccaaggtatttcctttttttaaaaaaatatataaacattgtaggggacacattgtttaaaaattgaaagtttttaccatccagactttatatttatgtaagttatcctcattctctactaattctccccacctctattctttcctagtagacttttcattacatcatattctaattaaatctaatttttaatatttattggtccacaaagcccttcagtagacggtagtgagaaacttgaagaagtcctgattttttagtcctggttcttctttaccaagtatgtaatttctaaaacctgtttttcctctcagcctatctcagatttaaaaacgtgggatgtattttcacttttgcctaatttacaaggttataataaagacaagtatttctgaacttatggtattcctttcatattgcacatccttcaaaagcattatagatttacataaaaaattaataaagttcaaattgtccaaagattatattgaattcatatcgaacttttaagta

SEQ ID NO: 101328 - DNA, 280 bp, Homo sapiens
catctttaccccctttgtgatcttacatatgggagaactgaggcacagaaataagttaggacagccagcaaacttgcatcagtataaatacaaagaagggaagggaggaacatgcttgaaaggggtgtgctggtctcagagggttaggtttctcagttggctgggcatcagctggccatgctttagttatttgatgggaggaaaaataagtgggaggtgaggagtaactcctgggctctgatgagtattctaggcaagtacagatctggaaagcctgtat

SEQ ID NO: 101329 - DNA, 395 bp, Homo sapiens
aaatggggtctcgctgcatcacccaggctgtagtgcagtggcgtgatcatgtctcactgcagccttgacctccccaggctcaggtggtcctcacaccttagcgacctgagtagctgggaccacaggtgcgtgccaccatgcctggctagctttttgtagacacagggttttgccatgtttcccaggctggtcccaaactcctagactcaagtgatctgcccaccttgttctcccaaagtgctaggattacaggcgcgagccaccattcccggcccctgagtagcttttcttgcaaaggcagaagtatcttttttgggggattttgaagaatgtttttccagacttattgttcctcccatttcctgtatgctatacatgtgtatacacacgtttcc

SEQ ID NO: 101330 - DNA, 193 bp, Homo sapiens
caagagttctagtctctccatatcctccataaatcatttgtcatttcctggggttattttgtttttttcttgtttgtagtatattttcccataacttcacttaccgtcatccttgaatcttaaactagttatatagttcagctctgcaaaatcaagttacctcatagcctagtcagaaatagaaacaagttcc

SEQ ID NO: 101331 - DNA, 285 bp, Homo sapiens
tcacctgtgaagatggtaattcctaccagtgctacagatgtcactgcaaatggacaagccaagtctagaagacgctaggtcgggattggacagccagaggctggaagatgattctaagaccaatgaaacagaaagggaagcatatcacaaaccagagccagacactctgctaggttctgaggattcagagaatgaattatttcctttccactaagaagtcggttagaacttcaatcgagagaacacacagagcaaactgggtgatcaacctgccttgtgaaaaca

SEQ ID NO: 101332 - DNA, 273 bp, Homo sapiens
aactcctgttcctcatcctgctcctgccagtctgatgtcaccacaatttgattacctctgggccagagagctcactacctaccatgcaggtattttgactcatctctcattgtttttctccctgcttactctgggggacttgagtcttcattataaacagccctgattttctagcaaagggttaatatttactaacaacataacaatcgcaatagcgactcctatgagttgagcacctgctgtcagtgaggtggtcagctaagtcctgtaatg

SEQ ID NO: 101333 - DNA, 342 bp, Homo sapiens
tttttaaacacctgtctaaatttttaaacaccttgactaaattatttaatatttctgttccagtttccttatttgcaaaatgaggataattgtactaattgtgagaattaagtgattatgcatgtaaagtgtttgcagcagtgtacttaccagacaagtgccccaaaaatgtttgtcttatctactttaattccctgtaaataccttgcttttggcctggtgctgtggctcatgcctggggtcccagcaccttgggaggctgaggcaggaggatcgcttgagcccagtagttggagaccagcctaggcaacatagtgagaccttgtctctagaaaaaaataa

SEQ ID NO: 101334 - DNA, 130 bp, Homo sapiens
aggcagaacccaacgagggccctgggacagcctggagggagtttcagaagacgaatagatagtaggacagaggggaagccgtgtcttctctaggtgcttgtctctagaatctggccagcacctgtcatat

SEQ ID NO: 101335 - DNA, 349 bp, Homo sapiens
aaagtgctgggattacaggcatgagccaccgcacccagccagcatttataattttaacataatggctaatactcacgaggggaagagatttttgaacatttttaaataatagagacagagtcttgctgtgttgcccaggctggtcttgaacgcttgactttgagccatcctcccaccttcgcctcccaaagtgctgggattgtaggcgtgaaccattgcacctggccctggggaagggatttttgtatttattaagcgtttagtacgtatcattgctttatagccctgttattctatggtctctacaataaccttattcatttagtttttcttctttcaacaaagaatt

SEQ ID NO: 101336 - DNA, 186 bp, Homo sapiens
taaattcgcggccgcgtcgacccaggatggtctcaatctcctgaccccatgatcctcccccactcagcctcccaaagcactgggattacaggcatgagccaccacgcccagcccttctaaagtattttaaattctagttttccaaagatgggaatgtgaattgtcttgtaaagtataaccgtctcc

SEQ ID NO: 101337 - DNA, 408 bp, Homo sapiens
gtcagggctatgttagttctactgggagaccacaaaatgacatggtccatcctcctccttatccaaagatgcatggttaaaataatatagattaggaatcatcgttacctccaaacagttaattcaattcaaatttttagcccagactggtttttaaagacattttctgccaaaattttttggaagtaaacacattaagggtaggtgtggagaacgattaatggattcatttttatactcacatctgttttggaaatatattttatgcaataaagcataaactaacaggtatacttataaatgtctggttttagaaacactaaaagatctccaatcttagaagccttaatttgaaattctgctttatcgcctgaactagtgactaactgtatagcatctcatgaagtg

SEQ ID NO: 101338 - DNA, 402 bp, Homo sapiens
actgcgcacctgcaacactgcttacacttgatacacttatgagatgtgcgtgatctctgactttccccttccttccagaattatcttttcatctcgattagatgctttctaactgtaatgaactgtggttaactcctgatagtcatccgccctgacgtgtttagtccaagctggttgtagaagatactatccctttctgacaatcagtagttgccatggaaatgaatgggatgtcacccaaacaacacttttggccaaaatattagattctatccttacctgatggtccagcctcagttcatctcagctggtctcctttgaaactatcaaagcaaatgctctctattttttccagtgagaaacatataccacgaatgaaacatttttgggtcctgatcatgt

SEQ ID NO: 101339 - DNA, 275 bp, Homo sapiens
tcggccttcaaaagtgctggggttacaggcgtgagccaccgtgcccagcccatccacactttttttgtgagttttacctccagggccttgaccaagatcccacagtgaatattggagaaaaatccccatgtgcttctggcaagggggccagaagggaaccattttgaaatacatcagtcagggcattctgttcttgacaaggccctaccctcagtagaaagtgaccagagcctgactgacctgatggaagggaaagaaccaactctagccagccc

SEQ ID NO: 101340 - DNA, 320 bp, Homo sapiens
ctgactatacgacatcccatacatgggacagacctaatacaatgaatctgaggaggctactcagatagacagtcccaccctcacacgattctttacctttcacttcatctgcccttcattattgcagccctagcagcactccacctcctattctagcacgaagcgggatcaaacaaccccctaggaatcacctcccattccgataaaatcaccttccacccttactacacaatcaaagacgcattcggggagggtgggaggggactcccagggagcggggcttgtgctggactttgcaggatgccagacttttggcaggg

SEQ ID NO: 101341 - DNA, 781 bp, Homo sapiens
ggaaatttcactgttatgagtaactaatctactttaagcagtgggtgagggtgcgtgtatccatgcatatgctaacgtgtgtgtagtagtattttcactacttggcatgcacctaaaatatgtatttgcaacatcatatttttactgttatttactgaacacctggtgcttgtacaacctgtcctaagtgctcaagaaacataaattgtgatctctgttgtaaagagccagccagcacatctgggaaacaaaacataacatgtttccttctctcagccaattgagagaaggaaaaccccgggccaaaccgagcaggaggtgcaatagtgaccattataggcattcagaagaagggaaataaagtctccaggagaagatgggtctttggatgtagaagagtgagatatctgagaaaaaaagagagcaaagactcaggagccggaaggccatggggagtttgcttagcacctggcctctgtggaggtcaaagcaatttcctcccaccttcatttttctatagtctgctagggtctcggaatatttatcgtgagtaaggatatcttatttcagagagaggacaatcaaggtgctgagatttttaaaggagggttcagataaaagtaaattaagctggccaggcatggtggcttaagcctgtaatcccagtgctttgggaggccgaggcaggtggatcacaatgtcaggagatcgacaccatcctggctaacacagtgaaaccccatctttactaaaaacaaacagaaaaaattagccaggtgtg

SEQ ID NO: 101342 - DNA, 401 bp, Homo sapiens
gcgtgagccaccgcgcctgacccataagcaccagttttacctgaaaagtaactactgggaaacttcaagttcctggtggtgaattcaaattttccaaaattccaattgccacttgaaagaaaatgacttttatcattggcaacaaatactgttagaagttctttcttgtaatgccaagttccattcattcacttttgagaaaatgtctgccagatacccaagtcttaatatgttcattcaacatatttcagcatatgtctgtcagccattttattcaagtaaaaattgtattccatgaaaaaagtagccaggtcagctttacggctgaattgagtgcttgtcctcagaacaacagtcctatttccatatgcagcagacatgtactctgactgtgaacgatt

SEQ ID NO: 101343 - DNA, 187 bp, Homo sapiens
gcagcagtgtcagggaatccatactctttattttaattcagcccatgtcgaagctatttagtttgagaaagatacacttaaccatcacaaaagcagcctggaccgcgggagggcttttgaatcatcttttcaaggcaaaatagctttcggaatatccaaatggctaattttgtccctaatgttaccg

SEQ ID NO: 101344 - DNA, 2316 bp, Homo sapiens
cgggagcgtgcgaggagctggctcggttatttcggagcgagagccgaggccgggggaagttcctgcggagtgctcaagggcagaagaggtgccgcgtcccgaagaggggaagcggagaagtttgctgctgcccgggtcgcctcgcgacgctgagagaatcgcccagccctccgcagccgcccagcgagaaccggagctgcggccccgcaccggcgtgagtccagctgagctgacacgccgagccggttgtgcctttccgagggaggaatgtgccgtggaatccaaactttggaaaacgtcccacccgaattcccagcgagcagcaaggagaccagagcgtcgatggagccaccgttagttgcgggagggctgtccccaagaggaattcatcactgtcgtccgctgggagggaccaaccttgaaatggggttggtggagagagggatagagaagagccggcgtgcttataaataacaaaacttagctatgaacccttccgattcccaagtggggaagatggggtaaaattctaagtgacttctcgctccgaagagggataccacaaaaagcggagcgcagggtacttggcgtataataagccatcaataatttatgggtgaaattgagagccaaatataagatgataaactgaagaataaaaacagctgacaaatactgtatagaaaagattgcgttggaatcataactgtggattggaagtgatgttaaggattattggattgagtatttgtagctgaatttctgctggcatttctatcagtggggaaagccctcacagctccataggtaatttttgttaggggaggaagaagtgttgttctgtcacccacccccaggcaaagagtcgctgatctaattctccatttctttctttctttcctttctttctttccttccttccttccttccttccttccttccttccttccttccttccctccctccctttcctttcctttcctttcctttctttcctttctttctttgaaacggagtttcgttcttgttgcccgcgctggagtgcagtgcagtgctgtgatctcggctcattgcaacttccacctcccgggttcgagggatcctcctgcctcagcctcccaagtagctgggattacaggcgcacgccaccgcacccgggtaattttgtatttttaatagagacggggtttcaccatgttggccaggctgtttgaactcctgacctcaagtgatccgcccgcctcggcctctcaaagtgctgggattacaggcgtgagccaccaagtcctgcctaatctcctttttatagttgaggaaagctagtaacttgactgaagtctcatatattagagctgtaactgaagtttttaagtgtctcaattctgcaactattcgtttttctatcacatcactgtttggcatatatatagcgggaaaaggaaaggctggaaattagttgaccacacactgattaagcttgaaacatatttctactggagaaaaaaaggtactgtaattttggcataggcatcacatattgctggagtggaaagacccatgcactcaggtcctgctttctataatctgtgacctcgggccagtcactccatttctcctgaactagatcactgatgatctgttgaaagaaaaaatatggctagtaatgccttaattatctcacagaggttttacatggagcaaaaagacaatgtatttttaaatgtactttgttgaaggtgtgtgttgtcgagacaatacagcagtgaagagaaggcatgcaaagctgtcttgttggagtctggctaaagagcaccaaagcagcctgttgtgggatgtcctctgggggccacctggacttgctatgttaacatggagggactaggcaggggtatgaagaaggaagcccagcagagcaggaggcagcagcaacaatgagagattggttatccatatgacttggatctgtgtccccacccaaatctcatgttgaattgtaatccccaatgttggaggtggggactggtgggaggtgactggatcatgggggtggatttcttatgaatggtttagtaccatccactttgtattgtccccgtggtaatgagtgagttcttaagaaatctggtcattgaaaaatatgtggcacctcctccctctctcttttgctcctgccccggctatatgatgcaatttgtcttcagccatgattgtaagtttcccgaggcctccccagaagctgagcagatgccagcatcatgcttcctgtacagcctgccttccatgagccaattaaacttctttcctttacaaattaca

SEQ ID NO: 101345 - DNA, 528 bp, Homo sapiens
tcacagcataagtgtcctccacatatgatgtacgcctgtaaatagttactgagctcctttgatctggccccacacacagcttcctttggggtctgtcccctgctctccgttacccgcgtggtagccatctgagcactggctcttcctggcttcactctctggcatcaaaacttatcagtcctacatctcagtcttttgcaaggtgacacttatctgattacctaattcacacgaaggtgttaatggtggtaatggcatagtatttattaccccaggggacccagaacggtggtatcaaaacatatcattccccagtggtttaaaactctggtagctttccagggagtccaagtggagtccagtctccttagctgagttcacagggccccgtctgcacgacttggcttctgtcggcttccctagccctgacttcccaagccttagtcatcaccctctctcccacccagggctcagcacagtacctggaacagtcaagccctcaataaatgtttactgagtgcattaaaa

SEQ ID NO: 101346 - DNA, 322 bp, Homo sapiens
ctttagcgtgttacagctgttcagctgtatcaggccctttattcttctgttttcttctagcaggagccatgttaaaggctcactcaccccttctccccatgatccttcttaaaatatccactttaaaagggaattgttatggaagaggtacaattgttagaataatcttctggtacagtagaaagctgggaggcttctgggctcttttctggcctttacaaactttgagccttaagcattttacttctctgaagctcaatttgctcttgatcagaagagcagagtaactgtggttctccgacagccgtgagagtcccgtgag

SEQ ID NO: 101347 - DNA, 194 bp, Homo sapiens
cctctgggcccctcaacccctacacttccttctaacacagccctgacttcatggggctgtcactgggtgttcatagatttgtcacccctactacattgaactcctggagggcagacagggccaagtgcccccttgtattccccagtgaccagcacaggatttggcctgctagagaagtctaaaaccttgattcc

SEQ ID NO: 101348 - DNA, 430 bp, Homo sapiens
tgaaacattcaagcaagagaatataataaaacaaacaaattcaatgtgatttttcattttcttaccgtttgctctgtttgttgaatgtcttttgctgtggttttcaccgaagcatttgacaggtcacacatggagcaaaggagatctaggtaggtccttgcctgctcttgcaaagctctgaagtgtttgacctggaaaaggcagttatcagagtgaaagagatgcatcagctatttagatagcaaatacttgtatcatttggaatattctgttgacatttcaaaaatagtcttgctatgctcagtgttttcaccattgtgttcaagtgacatatattagtgactcacaggaaaaaatttaaatcaccaatggggatttatttgtccaccatttgcttctccttgtaagtaaagtattctgtatggtctgg

SEQ ID NO: 101349 - DNA, 859 bp, Homo sapiens
cttcacaatagccaaaatatggaattaactgaaaagtccatcatggataaagaaaatgtggtatacaaaatggaatactattcaattataagaagaatgaaatcctgtcatttgcatcaacatggatggaactggaggtcattatgttaagtgaaaaaagccatgtgatgtcccgctcctgctttgccttatgccatgattggaagcttcctgagaccactccagaagcagatgccactatgtttcctatacagcctgcagaactctgagccaatgaaacctcttttcatataaattacccagtctcacatatttctttatagcagtgcaagaatggtgtcatacaccttggttggaagacagtgagatttctggaaccgttccctgaactggaatcttcaagtaattatttactctcaatcctcataacctgactggctaccaataataggacgttaaatcctacttcttagctgtttctgccatgccatacaaacctggatcaggctttttatcatctcagtctggactataaatcctctctgcttctgcttctctctgctctcatccatttttcaaacttgggaaaataaaactctttttttctgctaaggtttttttttaaattattattatactttaagttttagggtacatgtgcacaatgtgcaggttagttacatatgtatacatgtgccatgcaggttagctcagttggttagagcatggtgctaataaaaattttattgaaagcatacttgtccaaaggcaatgtcctaacttactagtttgcattcaaattcttctctaatcaatctctaacaatattttagttttttctattgccatattcctacca

SEQ ID NO: 101350 - DNA, 2576 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 101351 - DNA, 2627 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 101352 - DNA, 439 bp, Homo sapiens
ccacatgtgtatagtgaggagcatctgggtgcactggcctgcagggttgctgtagggaggagggaggaaggctctgctctatgcaatgcccggccccagccgtgtgtggggaagacagcgggggctgagaatcagaatcaggagcaggggaggagagtggcagacactccacagaccctgacccagcagaggtcatggaatcttgactcagatgctgtggggcggggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 101353 - DNA, 3761 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctccatctcttccgggctcaggcactggcgctgcgcgggactgtactcggcagggggcgtgcaggcacagcggtagccccgcgcgtgttctcacacactccgttccggcagttggactcgtccaggcactcgtccacgtccacgcattccagcaggttcccgtcgtagtagaagccctgcttgcagtagcactcgtagccaggctgcgtgttcacgcacttgccctccttgca

SEQ ID NO: 101354 - DNA, 3794 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggtacccagcacaggtctggcgagagggtagagatggtggacctcagccagaagtgggccccactgcagcccacacttctctttacagccgaggccagactcttggggtgaggacaactgggagggcctcgagactgacagtcgtaagtgcttcccctgggtgggctgaagactagggctccccgactagcccgcccctacaggcccccggcaggcactggctggagagctgagaccggggctccccttcctgacgccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101355 - DNA, 3520 bp, Homo sapiens
ccggccacacaacagctctgggaccatctcaggccccgctgccctcccctaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101356 - DNA, 3581 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101357 - DNA, 3587 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101358 - DNA, 3186 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggtgtacaaggggctggcggtaaaacagagtttggtaaaagaataccccagccagccccaccaggctgcaggatcaggcttggcaaactttactggcctccccttgcctcgatacagggtagctagaggctgggggaggagccgaggggtcctgagcatggctgactggcctggtccctgctggcctcctgtacccaatgagatctactcgaacccccaactgcttaaaaacagatctgtctctactgacttagaaacc

SEQ ID NO: 101359 - DNA, 2572 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 101360 - DNA, 2801 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcgtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101361 - DNA, 2837 bp, Homo sapiens
  misc_feature (2613)..(2613): n is a, c, g, or t
  misc_feature (2617)..(2617): n is a, c, g, or t
  misc_feature (2636)..(2636): n is a, c, g, or t
  misc_feature (2689)..(2689): n is a, c, g, or t
  misc_feature (2694)..(2694): n is a, c, g, or t
  misc_feature (2697)..(2697): n is a, c, g, or t
  misc_feature (2699)..(2699): n is a, c, g, or t
  misc_feature (2702)..(2702): n is a, c, g, or t
  misc_feature (2705)..(2705): n is a, c, g, or t
  misc_feature (2707)..(2707): n is a, c, g, or t
  misc_feature (2727)..(2727): n is a, c, g, or t
  misc_feature (2729)..(2729): n is a, c, g, or t
  misc_feature (2740)..(2740): n is a, c, g, or t
  misc_feature (2765)..(2765): n is a, c, g, or t
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctcgggccaaattcggcacgagcttaagtgtttaaagcattggttttttttaaagctcattggtgacacccccatggacaccttcctaatggaaatgcttgaggctcccaataaactggcctgagctaaaacccaaacggggggcttttaacactggaggagcccacatccaagagggactccaagccctggggnaggntggggggccatgttcccanaaccttgatggggtgagaagtccagggcggaccccagatacctgtgaggactngttgnctntnttnggngnccttgagtctttgaatttgncngggtctcccangatttggggggatttctaacctttntcctttccccagcacaaagcactggccttggttccagaacttgttcctttttattctggctaatttggcttc

SEQ ID NO: 101362 - DNA, 2780 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggtacccagcacaggtctggcgagagggtagagatggtggacctcagccagaagtgggccccactgcagcccacacttctctttacagccgaggccagactcttggggtgaggacaactgggagggcctcgagactgacagtcgtaagtgcttcccctgggtgggctgaagactagggctccccgactagcccgcccctacaggcccccggcaggcactggctggagagctgagaccggggctccccttcctgacgccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 101363 - DNA, 3298 bp, Homo sapiens
  misc_feature (3074)..(3074): n is a, c, g, or t
  misc_feature (3078)..(3078): n is a, c, g, or t
  misc_feature (3097)..(3097): n is a, c, g, or t
  misc_feature (3150)..(3150): n is a, c, g, or t
  misc_feature (3155)..(3155): n is a, c, g, or t
  misc_feature (3158)..(3158): n is a, c, g, or t
  misc_feature (3160)..(3160): n is a, c, g, or t
  misc_feature (3163)..(3163): n is a, c, g, or t
  misc_feature (3166)..(3166): n is a, c, g, or t
  misc_feature (3168)..(3168): n is a, c, g, or t
  misc_feature (3188)..(3188): n is a, c, g, or t
  misc_feature (3190)..(3190): n is a, c, g, or t
  misc_feature (3201)..(3201): n is a, c, g, or t
  misc_feature (3226)..(3226): n is a, c, g, or t
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccaggtacccagcacaggtctggcgagagggtagagatggtggacctcagccagaagtgggccccactgcagcccacacttctctttacagccgaggccagactcttggggtgaggacaactgggagggcctcgagactgacagtcgtaagtgcttcccctgggtgggctgaagactagggctccccgactagcccgcccctacaggcccccggcaggcactggctggagagctgagaccggggctccccttcctgacgccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctcgggccaaattcggcacgagcttaagtgtttaaagcattggttttttttaaagctcattggtgacacccccatggacaccttcctaatggaaatgcttgaggctcccaataaactggcctgagctaaaacccaaacggggggcttttaacactggaggagcccacatccaagagggactccaagccctggggnaggntggggggccatgttcccanaaccttgatggggtgagaagtccagggcggaccccagatacctgtgaggactngttgnctntnttnggngnccttgagtctttgaatttgncngggtctcccangatttggggggatttctaacctttntcctttccccagcacaaagcactggccttggttccagaacttgttcctttttattctggctaatttggcttc

SEQ ID NO: 101364 - DNA, 2167 bp, Homo sapiens
  misc_feature (2112)..(2112): n is a, c, g, or t
  misc_feature (2114)..(2114): n is a, c, g, or t
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcagtcagcatcgacaaatctcnantcccaagtcgagggcagggaagaggcctggaaggttgggggcatccggggccc

SEQ ID NO: 101365 - DNA, 2395 bp, Homo sapiens
ccacgcgtcgcggacgccgtgggtcgacccacgcgtcggacggtcatccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101366 - DNA, 2353 bp, Homo sapiens
ttaggctaggtacgaggctggggttgcaaccctgccatccgggagcagacggtcatccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101367 - DNA, 1781 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaagatgtccatcacctcagcctgcatgggagacccagctactggcagcttgtgataagatcctgct

SEQ ID NO: 101368 - DNA, 931 bp, Homo sapiens
ctttttgtgttgttgtttgttttttttttttaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101369 - DNA, 237 bp, Homo sapiens
catctgggtgcactggcctgcagggttgctgtagggaggagggaggaaggctctgctctatgcaatgcccggccccagccgtgtgtggggaagacagcgggggctgagaatcagaatcaggagcaggggaggagagtggcagacactccacagaccctgacccagcagaggtcatggaatcttgactcagatgctgtggggcggggagggcctttggagggtggaaacctggaagga

SEQ ID NO: 101370 - DNA, 529 bp, Homo sapiens
gtgagtgtcctggcctagctgcatcagtggctgagagggctgagagctgcaggcacccaggaactcttactgtctgactcccccggggatggtgaaggggatataggagctgggtaggctccagtcaccctgtgggcttccttggtgccccttccccccagtagcccccttcccctagcagcctctgccctgtcctcaagacccccctgaaagctcagtgagcctctgctccccaggagttcctgccccagcccccacccctgttcctgccacccctacaacctcaggccactgggagacgcaggaggaggacaaggacacagcagaggacagcagcactgctgacagatgggacgacgaagactggggcagcctggaggtgtgtggggctgagggagcctccccaggggaccccagctcaaatccacaggctgccattcagggagcttctgtggggcctggctggagttggcctgtcctcatcagcacagcatccctggcacgtaggcctcatggagtggccattgta

SEQ ID NO: 101371 - DNA, 2590 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 101372 - DNA, 3641 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101373 - DNA, 3604 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101374 - DNA, 3399 bp, Homo sapiens
atccacgcgtcgcggacgcgtgggttgaccacgcggtctgcaacatcctggcttacatcgatgtgactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101375 - DNA, 3395 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101376 - DNA, 3145 bp, Homo sapiens
  misc_feature (2921)..(2921): n is a, c, g, or t
  misc_feature (2925)..(2925): n is a, c, g, or t
  misc_feature (2944)..(2944): n is a, c, g, or t
  misc_feature (2997)..(2997): n is a, c, g, or t
  misc_feature (3002)..(3002): n is a, c, g, or t
  misc_feature (3005)..(3005): n is a, c, g, or t
  misc_feature (3007)..(3007): n is a, c, g, or t
  misc_feature (3010)..(3010): n is a, c, g, or t
  misc_feature (3013)..(3013): n is a, c, g, or t
  misc_feature (3015)..(3015): n is a, c, g, or t
  misc_feature (3035)..(3035): n is a, c, g, or t
  misc_feature (3037)..(3037): n is a, c, g, or t
  misc_feature (3048)..(3048): n is a, c, g, or t
  misc_feature (3073)..(3073): n is a, c, g, or t
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctcgggccaaattcggcacgagcttaagtgtttaaagcattggttttttttaaagctcattggtgacacccccatggacaccttcctaatggaaatgcttgaggctcccaataaactggcctgagctaaaacccaaacggggggcttttaacactggaggagcccacatccaagagggactccaagccctggggnaggntggggggccatgttcccanaaccttgatggggtgagaagtccagggcggaccccagatacctgtgaggactngttgnctntnttnggngnccttgagtctttgaatttgncngggtctcccangatttggggggatttctaacctttntcctttccccagcacaaagcactggccttggttccagaacttgttcctttttattctggctaatttggcttc

SEQ ID NO: 101377 - DNA, 3256 bp, Homo sapiens
  misc_feature (2995)..(2995): n is a, c, g, or t
  misc_feature (3000)..(3000): n is a, c, g, or t
  misc_feature (3003)..(3003): n is a, c, g, or t
  misc_feature (3005)..(3005): n is a, c, g, or t
  misc_feature (3008)..(3008): n is a, c, g, or t
  misc_feature (3011)..(3011): n is a, c, g, or t
  misc_feature (3013)..(3013): n is a, c, g, or t
  misc_feature (3033)..(3033): n is a, c, g, or t
  misc_feature (3035)..(3035): n is a, c, g, or t
  misc_feature (3046)..(3046): n is a, c, g, or t
  misc_feature (3071)..(3071): n is a, c, g, or t
  misc_feature (3121)..(3121): n is a, c, g, or t
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctcgggccaaattcggcacgagcttaagtgtttaaagcattggttttttttaaagctcattggtgacacccccatggacaccttcctaatggaaatgcttgaggctcccaataaactggcctgagctaaaacccaaacggggggcttttaacactggaggagcccacatccatggggtgagaagtacagggcagaaccaagccataaaccctccaaggatctgcttgatatcccaagttggaaggaaccccagatacctgtgaggactngttgnctntnttnggngnccttgagtctttgaatttgncngggtctcccangatttggggggatttctaacctttntcctttccccataccaaagattgcctttgcctcagggacttggtcctttnaatttgccaaatttgcttccaattgaagaatggaatggggactccccaaagtggaactggggggaggcctcccactgtggacttaaattgggcctaaaggctttttttttaacccggaaatgggcctttttgaaa

SEQ ID NO: 101378 - DNA, 2693 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgtaagtgcttcccctgggtgggctgaagactagggctccccgactagcccgcccctacaggcccccggcaggcactggctggagagctgagaccggggctccccttcctgacgccaggacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcaca

SEQ ID NO: 101379 - DNA, 2614 bp, Homo sapiens
tggacagctggacagcacagaggaggtggacagcacgggacaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101380 - DNA, 2410 bp, Homo sapiens
ttcctgcggttgactctagagcgatcccgtcacaagctgtccatccgggagcagacggtcatccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggagttcctgccccagcccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaccccttgtgccgggctcagtctagcccctgggaggcggctggggtctggcgccgccctgcgcagcccgcgcccacgtcagacgtgaacatcaatttgcttcgaaagccaagggtaaagaggcacgatctgatttatcagtttctaggaaacaccctctgggaggaaggcaggcagcgcccgccggagaccttacaaccgcccgctaaccggggaggggggccggtaggggcgcctcgggtctcaaggcgccgggagggtctgcgggccctgaaggtccctgggtccgagccacaagtcggggcagaagtgaggccgagctcgcggaaatccctcagtgatcaccgaggtctgggccgagggcggcgtcggcggcgtcagcggcggcgctggggaacgcaggccccgtgcgggcggctgcgcgcgaagccggctttgcagacgcagcggaaggagccgctggtgttcacgcagcgctcgctcttgcacagcagcccgcgctggttcagctctcggcactcgtcgatatccacgcagcgggcgcgggaggcgtcgagctggaagccgccgggacactcgcacacggcgccgcccggccgcggcacgcagcggccactcacgcagcgacactcgtctgaatcctcctctgaactgtcctcatctcttgggggctttccccaacagcagggggcttgtgtcccagaaggaattgctctcgctctgcgatgtcgggcaatgggaccccgcgccgcgcggcgggcacggtcggcattgggcgccccagccgcggccctggcggcagcagcagtcgtcgaaggtgagggcaggcccggccagggggccagcgcacatgccgtcctctccgcgctggctccagcacacgtcgcgccgctccggggcacgctcggccgggctctcggggagctggcaatcgcggccggagggcccgggcacccagggcgggcgacactcgcagcggtaggagcccggcaggttgacgcagcggccagggcggc

SEQ ID NO: 101381 - DNA, 1947 bp, Homo sapiens
gggctcgggcgtgcggaggacccggagctaaggcgcccgaacccgcggcggcggtggggacgatgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaagccactgggagacgcaggaggagaagacacagctaggtcatgacacagctgggggtcctctaagtcggta

SEQ ID NO: 101382 - DNA, 944 bp, Homo sapiens
tgctgggattacaggcgtgagtaaatttttgtatttttagtacagatagggtttcaccatgttggccaggctggtctcgaactcctgacctcaagtggtctgcccacctcggcctcccaaagtgctgggattacagatgtgagccaccgtgcccggctcagttgccatctttattggctagggaggaggggtgcctaaggtgctagtgtcagggatcactgagttggcaatagatctgattaactccagagagatctctgcttgccatcaaggctgggaaagaacgtgatgctctggaagcctatgaccacagttttagtaggcaggtagtttcctgctgcctccatagttacagtttaacttgctaaggttggtaggatgaaggtaatagattgcttcaggcacctgcactatgagagctgggtggatatgtcaacagaatggcacatctgtcagtgccaggaaacagacaccctggagtccttcccagctgttcttgaatcgtaagctccctgaactcagtgctccgtccctggggggaacgcctgccctagctgcatcccacaacgcaaaggggcttctccctgtgggagagctgtcagaaggagtcagaaaagtaaatatatgctgactcgcctcaaagattcataaatctggctccctgcttttgttagaaattggcttgcctcattgtcagctcagttgtggctgaactgtctgtcccaggtgaacagtgagatcaagtactggtgaaggctagaaagtgttttaatgatccctttttatgtgattagctgaagagcatctgacgatcaagttagggtagcataggtgctcactccgttgactcaaggctaaccttgctgtgaattctagcactctgactcatctctggggggccagagtagcttctgtttggacagtgcgaaactgatgaaaaacaa

SEQ ID NO: 101383 - DNA, 217 bp, Homo sapiens
gcacccctaatcagtcaagctgggatttacacttggagctgatgctgccagaactctgtctactgcacttggtcttgctcatggaaggatttggacagagcaggggcaagatcagctttgccctttagaaggaatcccctggcagctgcctgggggagggagtgcaggagaagaaagtccattgaggagcccccagcaggggtgctggatggagggg

SEQ ID NO: 101384 - DNA, 441 bp, Homo sapiens
tattaataccaagactgggtagaaaacaaaatccagctgcatgctgttccaagaaatatgcctaagacttaaagatggagaaaaattaaaaagtaaaaggataaggatagatacataccaatcaaaacggtggttgccaaaaatcacacaaaatgaactgcagggcaaaaagtagatactgatgaaagttcccccaggaagatgtaacaattctcaacctgtactcaccaaataatacagctgcaaaatatgtgagcaaaaatggacaggaccacaatgataaacaaatctaccataaatcaaggtttttaaaaaacatactctcagtaatttatagatcaaaggataaccacaaaaaaggtccaataaggatacagaaaaaatgaatgacaaaaagcaattaagaagtttgatctaataggtaaatatgaagcagttctt

SEQ ID NO: 101385 - DNA, 189 bp, Homo sapiens
gaaaatctaatgtaatggatgcacttagttttgtaatgggagagaaaatagctaatttaagagtgaaaaatattcaagaactcattcatggagcacatattggaaaacctatttcttcttctgcaagtgtaaaaattatatatgtggaggaaagtggcgaagagaaaacatttgcaaggattatccgag

SEQ ID NO: 101386 - DNA, 421 bp, Homo sapiens
ccccgccccaacagggctaagctgatacacacactgcggatgcaggcctgcctgctgggccttcctggtgtttgttttttccaggcaaagcacctctctctgcctcctgctggtttattcagcagtgtcccagggtttgctcattgtctgctttgcttcagacccttctatcaaattccattgtctctgtcttaatggtctttgcagggtaggcatggcatctgcatgttcactgaagggcctgcctgcatttccagggagagaaagccttcaggccactggtgcataaagatctttggaaatgtccagaagatcccaaacattgcctgtcctgcatgccaggcctcacttgccaccagcctgctccccagccgcacatccagctgtcatttcctagagaacccatcccacgcagttgttt

SEQ ID NO: 101387 - DNA, 404 bp, Homo sapiens
gcggccgcctactactactaaattcgcggccgcgtcgactgaattatgtctcaatgtgaaggggagggagaagggatccgaagaaaagtcatgttgcaaccaaagttataaggtagttaagagtagaaaggaggtacatgtagagtgagcagttatatatcctggagtcagaaagatacactttctaggtcttctagctgcagagctcctgattagattacagttcagtccacctgtgtccttataagaaagccctttcatatatgctagcttgagtggacatctgttccttgcagccaaacaagaccttcaaacgggacctgtttaaaaataattcctgaaacctttcattattttttcactccccctttctcattacctgttgacttccctttaattataca

SEQ ID NO: 101388 - DNA, 133 bp, Homo sapiens
gcttccaagcagagcccactgaatcaaagttgggtttcaggaagatcacggagttcagtgagcactcaacacctctatcagacagactgcgtgggcagtgccttcctggagaggggaacacagccggatgact

SEQ ID NO: 101389 - DNA, 3848 bp, Homo sapiens
gatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactta

SEQ ID NO: 101390 - DNA, 3363 bp, Homo sapiens
  misc_feature (2)..(8): n is a, c, g, or t
  misc_feature (209)..(209): n is a, c, g, or t
annnnnnncttactgtcagaggttactacaagtgtttgaacaggtaacttctacctttgaacttctgttgtgacagattcaaaggttccaggggagtgtgttggccactctcaggacagtacacagtagcttcgggtgtgtcccagtcagtcctaggagctgtggaaagagtagaagtgcctgaatgtggtgctgaatcaatacagccngctgtgaggggagcacttcctggacccaggaagggagagtcttcttccaaggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactta

SEQ ID NO: 101391 - DNA, 2902 bp, Homo sapiens
gatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacattt

SEQ ID NO: 101392 - DNA, 3795 bp, Homo sapiens
gatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactta

SEQ ID NO: 101393 - DNA, 2277 bp, Homo sapiens
gaatagaagcacagctgcctcagttatctcacggctgctgctgtaaccaacatgagttccatatccactccaacatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactta

SEQ ID NO: 101394 - DNA, 1796 bp, Homo sapiens
ggacgcgtgggtcgacccacgcgtcggggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactta

SEQ ID NO: 101395 - DNA, 3023 bp, Homo sapiens
gatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggaactgtgccaaaaccaagttgtaagggaagccattttagaagacttgcagaaaattgggaaagaaagtggccttaaaacttttgaacaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttccca

SEQ ID NO: 101396 - DNA, 572 bp, Homo sapiens
ctaaagaaccccaatttaatcgggcggtccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatactta

SEQ ID NO: 101397 - DNA, 2463 bp, Homo sapiens
gatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccctggacagtgatggctggcttcacacaggagacattggtcgctggctcccgaatggaactctgaagatcatcgaccgtaaaaagaacattttcaagctggcccaaggagaatacattgcaccacggtctctcagggtaccgagctcg

SEQ ID NO: 101398 - DNA, 2351 bp, Homo sapiens
gatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggacagcctgggcggaagggttcgtgtaattgtcactggagctgcccccatgtccacttcagtcatgacattcttccgggcagcaatgggatgtcaggtgtatgaagcttatggtcaaacagaatgcacaggtggctgtacatttacattacctggggactggacatcaggtcacgttggggtgcccctggcttgcaattacgtgaagctggaagatgtggctgacatgaactactttacagtgaataatgaaggagaggtctgcatcaagggtacaaacgtgttcaaaggatacctgaaggaccctgagaagacacaggaagccaaagatgtctacaaagacatttccaatgaggccgg

SEQ ID NO: 101399 - DNA, 1927 bp, Homo sapiens
gatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgagggaggagcacggaagggggtttcccagaagaacaatgacctaacaagttgctgcttctcagatgccaagactatgtatgaggttttccaaagaggactcgctgtgtctgacaatgggccctgcttgggatatagaaaaccaaaccagccctacagatggctatcttacaaacaggtgtctgatagagcagagtacctgggttcctgtctcttgcataaaggttataaatcatcaccagaccagtttgtcggcatctttgctcagaataggccagagtggatcatctccgaattggcttgttacacgtactctatggtagctgtacctctgtatgacaccttgggaccagaagccatcgtacatattgtcaacaaggctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgagaacctaggcaaagagcacttcagaaaacctgtgcctcctagcccagaagacctgagcgtcatctgcttcaccagtgggaccacaggtgaccccaaaggagccatgataacccatcaaaatattgtttcaaatgctgctgcctttctcaaatgtgtggagcatgcttatgagcccactcctgatgatgtggccatatcctacctccctctggctcatatgtttgagaggattgtacaggctgttgtgtacagctgtggagccagagttggattcttccaaggggatattcggttgctggctgacgacatgaagactttgaagcccacattgtttcccgcggtgcctcgactccttaacaggatctacgataaggtacaaaatgaggccaagacacccttcaacaagaacttctgtcgacgcggccgcgaatttagtagtagta

SEQ ID NO: 101400 - DNA, 481 bp, Homo sapiens
gtaagcctggtggtctgtccttgcctgaagaagacaaggtgaggtctgtggcccatctctctttctctgtctcacttctaaaaccccagctatttagatgcagtgatccaagtagaatcgcaacatgcaaaatagaggcaacattagaacatagtattaggatgggcgttggaaccagtgtcagacggacttaggtttgaaacctggttcttccatttccagcttcataaccttgtgcagaccactttgcttctctgaatctgtttctcaacacaagaagaacgtccctgccaaaactgttgttaaagggtcaaggagataataatataggacagtatctttaactcactagtacctcatatttgtttagaaacatgcctttcattaatgtaattccctgcatttacagatagacaatctgagccaggactagcagtccaggattcctgatgtcttaccttgtccttaactctgataccat

SEQ ID NO: 101401 - DNA, 654 bp, Homo sapiens
gagcaagttcaagggtgctggtgatgctccttaacctcattctgagccagcactccctctccttgggccacactgtccaaatgtcctgtgtcctagttattattgccaaacctgcatatgaactggaagttgtgattgctgggtaactctgcagccatctgcccttggcgtttcagatgtttgtaatcaattacctctgtcctaataacacccttaatgattaaatacataaatcacaaaaaattgcaacattccttatacaagaaaaagtctgtccaatgttaaataactgaatgtgtagcttatgtatggtttgattcaatatgtacaaggtgaggggtaggaggggaggggaaaaaacaaattccccctcttgccgaagctattggagacctcaggctggcctcctttctcagtcttggcactgctgtctgccaggaggtagcatctgggttcactcctggcatctcagatctgttgcattgcagtcccctctagacgctgaagcagcgtcacggtgcagacaagtagggccagtgacgagggcagccacacagaggactgcaatacgtacctaaccttgagtttgaaagatggcctgggaattgagcaagggagagagaagaagcttatttgcatccccaaattgagaat

SEQ ID NO: 101402 - DNA, 491 bp, Homo sapiens
actggcttccttccccctactactctcttttcctttgtagtaaaactcttcaaaactccaccttgctgccccagcccctctgctgtccttctccctctccagagcaccccacttttgcttttgttgcccgccaagtctaaaactgctcaagacccccaaggacctgtgtgagctctggtggctcattcctggctctccccttaccccacctgtccacaggattgagactatctctcctctcctgatgaggcactgccctcagcttttgcgtctcctgggtccctcgctggccacttaggctcagactctgcttgttcctccactgcatcccagcctgccaaggcaggggcgccccaggcctgggtccttgctcctcttctctccacagacgcccccggatgacccatgccatttccggcataaaacatcatggagggaccaatcaggcacaagtccacaggcacaagtccacctctcctgggtctctctat

SEQ ID NO: 101403 - DNA, 386 bp, Homo sapiens
gcagttaggtatggccacgtgacagtgaggtgtggccatgtgactgaattctggtcaatgaatgaaatacgtacaggagtgacatatgccacttacaggagtggctcataaaactttccacaattgttccttcaggctcttttctctttctgactagctggctactgtaactagtaggcctagataatccccaggacaacctcagaagtgatgttgttggccaggcatggtggctcatgcctgtaatcccaacactctgggaggccgaggcaggcggatcacttgaggtcaggagttccagaccagcctggccaaaccccatctggtgaaaccccatctctactaaaaatacaaaaattagccaggcatggtggtgtgcacctgta

SEQ ID NO: 101404 - DNA, 891 bp, Homo sapiens
cattcctgaacaaatattcatctcaggttagatttttccagtaagtaaggttcagaggcagtggcaagtggaggaaagtgaacaggtaacacacttgagagcgatttgcatctggattgttcagaaagcaagctggtaagagaggaaggagatgtggtccagggtaagatggggcagatcacctgggccttcagccatgcagaggggtctggatttcatgggaggcggtgggaacagctggagaagaaattatatctgatccacattccaggaattggcagaacagctattctgagactgcgtggggttgtgcggtacctgggttcacttacatagcttctggggccccagaagactctccatctgtgggttgcaattaacgcccgtgccgccacccagaaagaagctgccaaccacagaggccttgtaaaagccacctgctgctattgatgctttttgttggactctgccccaaagcagcccagtacacctggcccagggcaggatgcagggaggccgagttcctagcaaccctttgttagttttcccagctctcctgtcgataagcaattgtaggcaccttgtggaatcaggaaccccgggctcaccagttccttttgcgtagatgagaaaaacctaggctaggagagcgcagtgtcctcacatggctggtgcagcctctgatccacagcgccacaaagcttgcagaaggtggttggcttttgttctgaatctaacaagacttatcgggaggctcttggtgcctggcactggctgaatgcccaggttgggggaggcagagcagatgaagcatctgcccgcgagggtgggtggagctgcttgtgaaacgtatcatcgtagcccgggagctgggacactgaagcccggaga

SEQ ID NO: 101405 - DNA, 881 bp, Homo sapiens
tgcccacctcagcctcccaaagtgctgggattacaggcaggagctaccacacctggcccagcataactcttaagtaggagttaagatttatcagccttggaacagaagatataagtggtcctgattttcagtagaattggaaaattggggccaatgaaagaatgactttctatcaggtttccagcatcttatttcttttacaagtatctatttgaaagtgatttcttttttcataattttttgtatgtctcatctaatgctgcagttatcaaaaggctcccaatctcttttagttgctgtaggaactaaactaaacttctttaattactttgagaaatattcccttttgcatgcactacctgagaatcacagtaagatgatggggactttttttaggggaggaaaaagggttcatttacttgaagaaatcatgtacatttttcttttcccacacatagcacttctcatgtaggggaatcaacttgtttcctcacagatgtttttcctccctgccctccctctcagtcttcttagtttgtgcttgtccaagccttatgttattactcttagtggcatctttgaagaagaaaagatttcggtacatagacaagctgataatagaataatagtaaagaatttgtttccgtctcaatcttagagattggaaaagctctctgtctcatccagggatttggagggtcagagcaggtgagtgcccctgccctccacttactgaggcttgtttcccaagggagcaccatgctgcatgaagcacatgtgcatgctccacagcatttgaactgcagagtccgtcatcctgtgttcctgatttttatataaaatctgttgttagataccaattcaagaatcaggtagagaca

SEQ ID NO: 101406 - DNA, 330 bp, Homo sapiens
atctcaaggcagaagaatttgtcttagtacagaacaaaatggagtctcctatgtctacttctttctacacagacacagtaacaatctgatctctcttgcttttccccacactctcattcagcataatcatgctgatatttatccaagtctaaaatcctttgatattcatccgtgatacacatccatgttgcatgtgtcaaaagcccattcccctgtatggatctaacacagcctgtttatccattcacatgtggatggatttctggatcatttccagtttttgctcatacaaataaagccgctgtgaacctttgtgtacaaatcttggtc

SEQ ID NO: 101407 - DNA, 419 bp, Homo sapiens
agagtgcagtggccctgtctcagctcactgcaacctccacatccctggttcaagcaattctcgtgccccagcctcccgaatagctgagattacaggcacatgccaccatgcccagctaatttttgtattttcagtagagttgggatttcaccatgttggccagggtggcctcgaactccagacctcaggtgatctgcctgcctcagcctcccaaagtgctggaattacaatcatgagccaccactcttagcctctacaaaaaaaatttttttagttagcaggtgtggtgatgtgcacctttagtcccaggaggctgaggtaggaagattgcttgagcctggagaggtcaaggctgcagtgagctatgattatgccactgcactccagcctgggtgacagagtgagaccctgtctcaaga

SEQ ID NO: 101408 - DNA, 598 bp, Homo sapiens
gtgagtgtgttttcgtgtttggggtggaaacgtaggcggggaagagaaggaggagaggggagtgcctgcagtccttcccccttcccttcctgctaagagatcaaagtgcagaggaaatccagacgggaaatgagagaaaggaaaaacagcagccgtggaagcactctcttttttatatcgctggagactcggccgagcaactactggaaccattaccatttcttaacctttagtggagtggctgcctttgcctattaactggaagggcactttgtaaacgcaggcgaggcacacacctacacacacgcctacacgctgggggaaaataaccacattctgggggacggagggaggcccaggcaaggcgcggccatggatctctactgccagagctgcgagggcatctggccagcaacacccggcttcttgggcgaacagtcgcccaagagtccacaattttcttgtgactcaaatagatggataggtgcatggatggatggtgcagaatattcatactctgtctaatctcaagtggactggagtcaacgcatttttaaatccatctaccttttttagaggcacagcatttaaaaccctg

SEQ ID NO: 101409 - DNA, 628 bp, Homo sapiens
gcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggag

SEQ ID NO: 101410 - DNA, 947 bp, Homo sapiens
actggataaattttatgactatatttaattaatatgagcacattttagagtggagaaaacaaagacttcattcatccagcaaatatttattcagtacccgaagtgctagaaactatatgagggtagtaaataaaatagaatattcctgtcctactatggagggggaatggagagggagtggaggaatagatgataaacaaacaaacaaacaagcaaactagttcattgtacataaagaagttatttttttctgacagtaactaacaaaggtctgggcaagaatcagagggtgaccattttaagaggtggtgtttctgttgagactcaaatgataagaaggatccagtgatgcagaaatccagggcaaggaataggatgtttgaagcctccatagaagaaaagcattttatagtagatcagaaagcaataacaaaaaagaaaaaagaaaaaaaaaacatttggcaatgtctaggaacaaaaaggacattaacgtgggtagaatgctgtgagctaaaaagagagtagattgaaatgaagttaaagagaaatggagagacagacctcatagaattttgccctaaatgaaatgggaagccagggaagtatgacacagtcccataataaacctgcttctggtgcagaatggattggaattatcaaggcagttagtgaggaatccagttagaaggtgaatacagtggttcagtggtccaggatggaaatcacagtgacctcaactaagaaggcagcagtagaggtagagagaagttgatagatttgtcagttaagtcctgaatcaccttgattgttacctactctctctctttggttcttaattttgtcttctgtaaactgggattaattatattaatgcaaagagatgttcagaacatgatttgagacaagacatgagtacctgacataaggtaggatgcagtaaatctcag

SEQ ID NO: 101411 - DNA, 751 bp, Homo sapiens
gatgacgtctagcactagtaatgggtctgtaataaagtggcttacctcttttgggcaaactgaaaatatgacaggaagtaagcaaagagaaaaccaagcttggacagcagtgagccagagtaatccatatagtggtaatttcagattcaatgtagggatcaattttatccttaataatggaaggctgaatacagaaaatgaatatgcatcatctgcaagatttcccaggggagaaaatagggaaaacagaggaaagtggaaaatccacaatctgagtcaacatttgcaaggccacctaggtcaggtacaaagtgcgacagaagtattaatgaaagttccacttaccagaggtcagagaagactgagaagcaggagcccagaccaatggagaaccagagcgagaaataaaagtaggttccctccaaattcatggtgagaaatttcacaaatatttcatgataatatacatctcagacttttgaatgacccctggtaaatgagacagagattttctagaactcagcaacatgagacattgagagagcaaataactgacccatagttgcaaagtggcatgtttttgtagcttttggaacatggaatgcctttccaggaaaacgttctccagacacaatcagaaatggtgaatctggggcactgagactgagaaatccagtcatagtcctgattgtgatagtaggaagagttcatcatggggaatatttgccaagatatagcacacctaatagaa

SEQ ID NO: 101412 - DNA, 288 bp, Homo sapiens
tgatgaggagcagctagaagactcgagggagaaaaatccttgtagacacatcagtggattcaggtgacttgtgttatttttaaaatacagcctcgccaagatacaattcacacagtctccaacctaacgatttagctctgcttttaagactgtgttgggtttgactttttttgaggggcctcggccactcttgggttgtttgtaatctaaaaataattggggatgaatattggttacatttcatcccgtaggaccttagtctgtctggtcaccacttacccctccagg

SEQ ID NO: 101413 - DNA, 325 bp, Homo sapiens
gccccaagtgattcccacccacattaaggtttgagtgttctgtgatactgcagatagctgtaaaaattaaaaatgctcaagtttacaaatgaattcagagatatggtatgaaaagtaccaagacacggaatcagaaaagcccaaagagaaaaaccaatatataaatgaatttctttgccaccgatagcaaaggctcatttttcaacaatacctatttattgcttcctgctttaagtattttgtgcaagagcacaacacttataaaggtttacaaaagaattaccgggtctagaaattccaggcaacctggtccaaacgtgtgaaa

SEQ ID NO: 101414 - DNA, 321 bp, Homo sapiens
tgcatgaggggagggggtgtgtgtctgttttgttcactgctattaccccgtgcctagaacagtgcctagcatgtggaagactcccagatacaataaataaatgagcaaactgggcatggtggtgcatgcctgtagtcccagctacttaagaggctgagacaggggcattgcttgagcccagaggtttgagtctagcctgggcaacatagggagaccctgagaaagaagaaagcaaagcaaagctaaaaaaaaaaagaaagaaaaggaaggaaagaaaggaaggaaagagagaaaaatagagagaaagagaaaaagagaaaa

SEQ ID NO: 101415 - DNA, 541 bp, Homo sapiens
taatcagctcgtacccttcccaccagcaaagacggagctgggagactttccagaggcacagtgccaagcacgtgggctgcaatctgaaggttgagtgggaatcaacaaggtaaaggatggagtcttggggaggaccatcacaggcagaggatttctgtgggcaaaagcccagatatttaaagcatgaaacatttgaagcccacaagtgttggaaccgaggagaaatgcatttgttcaatgcattcatcaagcacttaggcagtgctgagcatggtttgacagcacacagtgagagcctgccctccggggtgccctgtggccttctttattggtattatcattgttattactttttctcattccttttcagttaatccaggttcttcttatgtactcatctccttcatctctgatttctcttgcccacttagaaatgtgtttatccattttgccaatctccctccatattcaattctattcatagctcataagcttatgagctatatgatatggttttccttttattttataaaagaataag

SEQ ID NO: 101416 - DNA, 886 bp, Homo sapiens
  misc_feature (7)..(8): n is a, c, g, or t
ggcacanncctcgctcggctgcggctctcgggtgtcccaggcccggccggtaagcagagcatggcgggtgcgggcccgaagcggcgggcgctagcggccccggtggccgaggagaaggaagaggcgcgggagaagatgctggcctccaagcgcgcggacggcgcggcgccggcaggcgagggcgagggcgtgaccctgcagcggaacatcacgctactcaacggcgtggccatcatcgtgggcgccatcatcggctcgggcatcttcgtgacgcccacgggcgtgcttaaggaggcaggctcgccggggctggcgctggtgatgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcgtcatccggccttcatcgcagtacatcgtggccctggtcttcgccacctacctgctcaagccgctcttccccagctgcccggtgcccgaggaggcagccaagctcatggcctgccactgcgtgcgccctggcaggagggactggcttacgccaccctgtgcaggatcgtcttctcagcttacagagcctagtgtgattcaacaaccctccatctctgcccccaacatgcccaactgatctggtggagggaactgaagatgaaggcctctcaggcaccatggatgggatgggtgtgtgtgaagggggcagggtccccaggagctgccccaggtctggctggacagttgcacgggaagtcctgtttgtgaactcaacgtttccacggcttttccattaaactttaccccaaatc

SEQ ID NO: 101417 - DNA, 361 bp, Homo sapiens
agggcctggcccagatcatcctcgctgggctatcgatccagcatcgggaagcggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccattcaaccggaggcgttcaatggccccccatcatgctggtgctcatgaccgccaagatcgtgggcgacgtcttcattgagggcctgtacgacatgcacattcagctgcagagtgtgcccttcctgcactgggaggccccgg

SEQ ID NO: 101418 - DNA, 4823 bp, Homo sapiens
gggtcctgacgcaactgcgggccgcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101419 - DNA, 4791 bp, Homo sapiens
  misc_feature (7)..(8): n is a, c, g, or t
ggcacanncctcgctcggctgcggctctcgggtgtcccaggcccggccggtaagcagagcatggcgggtgcgggcccgaagcggcgggcgctagcggccccggtggccgaggagaaggaagaggcgcgggagaagatgctggcctccaagcgcgcggacggcgcggcgccggcaggcgagggcgagggcgtgaccctgcagcggaacatcacgctactcaacggcgtggccatcatcgtgggcgccatcatcggctcgggcatcttcgtgacgcccacgggcgtgcttaaggaggcaggctcgccggggctggcgctggtgatgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcgtcatccggccttcatcgcagtacatcgtggccctggtcttcgccacctacctgctcaagccgctcttccccagctgcccggtgcccgaggaggcagccaagctcatggcctgccactgcgtgcgtgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101420 - DNA, 3748 bp, Homo sapiens
gaccttgcatgttgctcagatgaggtttctcctttaaaacaaaattccctggtgctcagctgggcccagccaggctggacagtccccggtggccaccacggccgtccacagccctggtcgtgggccccagggctcagccagccgcctctctcttccagtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101421 - DNA, 3606 bp, Homo sapiens
taagatgtatatgaaacacaaatgaatttcaagtttagacttgggccctatctccagggtatctcattatatgtataccaacattacaaagtcaaaaaaaactccaaaacacttctggtcctaagcattttggataaaggatactcaatctgtactattttctctttcttttttatagacagggtcttacactgacacccaagctggagtgcagtggccctatcatagcttgctacagcctcaaactcctgggctcaagtcatacatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101422 - DNA, 2897 bp, Homo sapiens
ccacgcgtcgcggacgcgtgggtcgacccacgcgtcgctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101423 - DNA, 4724 bp, Homo sapiens
gggtcctgacgcaactgcgggccgcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101424 - DNA, 2580 bp, Homo sapiens
cttctaggtcgagctcgggtgtactcggccgaggagcccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101425 - DNA, 3920 bp, Homo sapiens
gggtcctgacgcaactgcgggccgcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtgaaatcgaacgggatcctctagacaccaca

SEQ ID NO: 101426 - DNA, 2314 bp, Homo sapiens
  misc_feature (15)..(15): n is a, c, g, or t
  misc_feature (22)..(22): n is a, c, g, or t
  misc_feature (25)..(25): n is a, c, g, or t
catttggctagtagngccgggngtnaatcggacgactaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101427 - DNA, 2117 bp, Homo sapiens
  misc_feature (20)..(20): n is a, c, g, or t
cgaggatggagtaaaaaccntaggctaggtacgaggctgggtgttgccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101428 - DNA, 1760 bp, Homo sapiens
ccacgcgtcgcggacgcgtgggtcgacccacgcgtcgacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101429 - DNA, 1610 bp, Homo sapiens
ctctctctctctctctctctctctctctctctctctatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101430 - DNA, 1444 bp, Homo sapiens
cccttacggctagtagaggccggtgttaatcggagaggcacagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101431 - DNA, 1125 bp, Homo sapiens
caaatccagctcggttccccttttggggtctttgctaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101432 - DNA, 1025 bp, Homo sapiens
gggtcctgacgcaactgcgggccgcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccattcaacgcctccgaggcgttgaatggccggaggcgttgctttgaactttatttgagaaaaacagaagataaatgtatcaaaagaacacacaggtggcggg

SEQ ID NO: 101433 - DNA, 700 bp, Homo sapiens
cagagaacgggtggcaagtgagggccccattcagggcgggacggtacagaggagctgcctgggctctcggctctggtccccggctgtgcagctcgtgggcagagccttagaattcagaccaggtggcctgacttaactctcctgagcccttgaggtcaccccgaagaatccccatttctcaggtggggaagctgaggccgcggccaaggcaccagccagggctgtgcagtgtcccgctccaggcacagcctcctgccgccagcctgtgtcctcttgctgcttcccaccttccccgagaagcccagcacagaggctggagctactgcttgcgaggagcccacctggctcctgggcacagggtttggccttcagcccgggccgcgttgggtgacatgtcgtccctgttctttccagaaacctgcccctggccatcatcatctccctgcccatcgtgacgctggtgtacgtgctgaccaacctggcctacttcaccaccctgtccaccgagcagatgctgtcgtccgaggccgtggccgtggtgagccgctacccgccagcttccaccaggggcctgagaggctgtggccagcccgtcccttccagaccggagtggtgccccacatctctaagcctcccctacgcagagggggccccgcgtctctaagcctcccctacccggaggggtggagtggtggtctcc

SEQ ID NO: 101434 - DNA, 1246 bp, Homo sapiens
  misc_feature (7)..(8): n is a, c, g, or t
ggcacanncctcgctcggctgcggctctcgggtgtcccaggcccggccggtaagcagagcatggcgggtgcgggcccgaagcggcgggcgctagcggccccggtggccgaggagaaggaagaggcgcgggagaagatgctggcctccaagcgcgcggacggcgcggcgccggcaggcgagggcgagggcgtgaccctgcagcggaacatcacgctactcaacggcgtggccatcatcgtgggcgccatcatcggctcgggcatcttcgtgacgcccacgggcgtgcttaaggaggcaggctcgccggggctggcgctggtgatgtgggccgcgtgcggcgtcttctccatcgtgggcgcgctctgctacgcggagctgggcaccaccatctccaaatcgggcggcgactacgcctacatgctggacgtctacggctcgctgcccgccttcctcaagctctggatcgagctgctcgtcatccggccttcatcgcagtacatcgtggccctggtcttcgccacctacctgctcaagccgctcttccccagctgcccggtgcccgaggaggcagccaagctcatggcctgccactgcgtgcgtgagtacggggcgcgggccgggggttgggaggtcgtggtccctgggtccctgcatccttgcatcactacgcccctggctcccacatctctacatttttgcgttcctggaccgtcccggcagttctaggctaaggtcattggtcccagaaaccacgtgcgtttctttcattcattcgtttacacttctccccacgggctgggaatatcttcagtgacgggacagcagggtccctgccctgcccttcggtgggcatttcattcccccacttaagcggttcaggcaagtgccagcctcccgttggccccgctgagcaatactcccagcctcttgcgtggcacccacgtggagtaactgagcaaccggtttattgttaaagctccgattgctgactggttgttgaaaaggaaattgcagttgaaaagaaaattattcatttctgctctccacaccagctcgtcaggaatcagtgacacgggctgactcataagaaaacagtagtaataaaatcgtgtgcgggtagtgactggtgctggtttaggctaagggatcccccctgagggttgcccagtagtgagagagcggagcttggctgcagattcagtctgtgttgcagtgattcgcgaatgggtacacagctcgactctgg

SEQ ID NO: 101435 - DNA, 4240 bp, Homo sapiens
gtcctttcacgcgtgtcttcgtgttggtgcgcttttcactggtcataatgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101436 - DNA, 4306 bp, Homo sapiens
taagctaggtagagctggtggtatcggccgaggtcgcactactgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101437 - DNA, 4718 bp, Homo sapiens
gggtcctgacgcaactgcgggccgcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101438 - DNA, 2812 bp, Homo sapiens
  misc_feature (20)..(20): n is a, c, g, or t
cgaggatggagtaaaaaccntaggctaggtacgaggctgggtgttgagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101439 - DNA, 4727 bp, Homo sapiens
gggtcctgacgcaactgcgggccgcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101440 - DNA, 4658 bp, Homo sapiens
gggtcctgacgcaactgcgggccgcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccaactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101441 - DNA, 2162 bp, Homo sapiens
ccacgcgtcgcggacgcgtgggtcgacccacgcgtcgccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101442 - DNA, 1758 bp, Homo sapiens
  misc_feature (15)..(15): n is a, c, g, or t
  misc_feature (22)..(22): n is a, c, g, or t
  misc_feature (25)..(25): n is a, c, g, or t
catttggctagtagngccgggngtnaatcggacgaacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101443 - DNA, 1369 bp, Homo sapiens
  misc_feature (19)..(19): n is a, c, g, or t
tcaggctgtacgccccgangttggatatcgtcgaccacgcgttgcgctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaacaaaaaaagtgcagcgggaaaaggctaagggcgccaacggtccacgtaggctttcaccccagcaggggggttatcactaggctaaaccgggacaaagaccggaaaaagatcctcgaacgggaaagccaaatctcgccaagtcggaacggcacccggcgcactcacccgggaacgaaacctttggcgacagatgccggacataacacgtaatccttattataccaacgtctggattcacaatctggat

SEQ ID NO: 101444 - DNA, 1725 bp, Homo sapiens
gggtcctgacgcaactgcgggccgcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgctgaagatgatgttgggtaccgag

SEQ ID NO: 101445 - DNA, 605 bp, Homo sapiens
cacggtttctccagagaacgggtggcaagtgagggccccattcagggcgggacggtacagaggagctgcctgggctctcggctctggtccccggctgtgcagctcgtgggcagagccttagaattcagaccaggtggcctgacttaactctcctgagcccttgaggtcaccccgaagaatccccatttctcaggtggggaagctgaggccgcggccaaggcaccagccagggctgtgcagtgtcccgctccaggcacagcctcctgccgccagcctgtgtcctcttgctgcttcccaccttccccgagaagcccagcacagaggctggagctactgcttgcgaggagcccacctggctcctgggcacagggtttggccttcagcccgggccgcgttgggtgacatgtcgtccctgttctttccagaaacctgcccctggccatcatcatctccctgcccatcgtgacgctggtgtacgtgctgaccaacctggcctacttcaccaccctgtccaccgagcagatgctgtcgtccgaggccgtggccgtggtgagccgctacccgccagcttccaccaggggcctgagaggctgtggccagcccgt

SEQ ID NO: 101446 - DNA, 1019 bp, Homo sapiens
gacaagcttctcttcacaggtggagtttctggtgtctaagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 101447 - DNA, 1958 bp, Homo sapiens
caaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 101448 - DNA, 778 bp, Homo sapiens
aattttatttttgagacagtttcactctgttgcccaggccggagtgcaatgacatgatctcggctcctgcaacctccccatcccgggttcaagcaattcttctgcctcagcctcccaagtagatgggattacaggcgcccgccaccacgcctggctaatttttgtatttttagtagagatggggtttcaccatgttagccaagctggtctccaactcctgacctcaggtgatcaatccaccgcctcaaactcccaaagtgctgggattacaggtgtgagtcaccatgcctggcctattatttttcttaatcaacagaagtgctagccaaaagcctaaaaagcagatgcctacacttttttttttttttgagataggatctcaatatgttgcccaccgccgccggtctcaaacttttggcctcaagccatccttctgctcagcctcccgagtagctgggattacaggcatgtgacaccacacccagcttatatacacaactataaaactaagtttaaatgtcttatgtttatataactagataagcaaaaaacaaacttataaattaaatacaaacaaaatcaccaaaccagcaaaattcaaaataacattaatcaatgatgccgctcaaattaaaatcactgcccacaaggtaaatatggtaatggcataggcctaaaaacaggcagacagaacaagagagcctggaaagatacacacggaatccctatagcccttacaaaagccaccttaggaaatgccccgtacctgcaatttgca

SEQ ID NO: 101449 - DNA, 192 bp, Homo sapiens
ccacccgggacaggcctaactcttaacacattcctcaacccatctctctaaagacccgtcccagtcgttaggttcgctcatccctgacctcaccccagaatacgttaagactgcctgctccatctctgaagcccacctgcagcctagccatggcccttccctagtgggtaagatctgctccaacccgaacca

SEQ ID NO: 101450 - DNA, 200 bp, Homo sapiens
ttgtatagaaaattgaatcttatgcatattataaaaaaggaacttatcagcattgtaataagccagtcattttgtattaactctatcattatgtgtatacatatctttcatatacactgaaaatgtctagaatatataaactgttactaagttaccctgtcaggactgggattaggggaaggatacttttcctctatata

SEQ ID NO: 101451 - DNA, 833 bp, Homo sapiens
aacagtagcaaactgcccctgttccattttgttctttggctttttgcaataaatcttgctgctgctcactgtttggacctgcctggcctttatgagctgtaacactcaccacgaaggtctgcagctttgctcttgaggccagttaagaccacaaacccactggaaggagcgaacaactccagaagcactgcgtataagagctgtaacacccacagtgagggtctgcagcttcattcctgaagtcagcgagaccacaaacccaccagaagcaagaaactctggacacatctgaacatctgaaggaacaaactctggacacatcatctttaagaactgtatgactcactgcaagggtctgtggcttcagtgagaccaataacccaccaattctgaacacactaatctttattaatttatgtggggaatgaggttaacacttctaaagttagattaacgttatgtgagaaaattcaaaatatgggattttttttcacggattctttgttactctgctttatagcaatttcagtaagatattctatttggataaaggaatcagttatttgaaatttaaaaatatagtactgagttttgtgttccccttcctgattgcatggactcggctgctgaacaaagttatgcatttactttacttttgataattaaaattgtgagatcctcaagggcaggaacaatttccttttgattcctagcagtaagtttttgcatcttgaaggtgttcaatgaatatatgttgaatgaatgcttgtatccttaatttggaaagtaataagtatttgtcaaaagaaaatgaaaaacaatatgcaggaaaa

SEQ ID NO: 101452 - DNA, 259 bp, Homo sapiens
aatgctaggattacaagtgtgaaccaccgcacccggccaatatgtcttatattaaggttatctgagctctgaacaatatataatccctgatagagatgctatgacaatattttttcaaggcttagagttgaattataacatgagtgatcactactgattctctctttaaatacaaatatttttcctatagtatattttacatttattttttgggctgaactaatttggactacttgtattatgaaacatgtttcttggt

SEQ ID NO: 101453 - DNA, 198 bp, Homo sapiens
tcacttttaacacgaggaaggggctgaatgtcatgaactctaagtcccttccagtttataaactcctggattcctttttctccaccttttccttcacgtggccacatgtgaagcgcagagtttagcatttaagctgacctcttgagccctgggttccttatctaaccaatgatgattctggggcaggctggctgacag

SEQ ID NO: 101454 - DNA, 660 bp, Homo sapiens
gctggctgggacagcacccggtaatctgcatttttacacactcccaagtcattatggtggaggcaatcacagatcacactttgagaaatattggagtaaccaaatgcatacagggttcatatctgaatgcagccttaccatgtgtaagctgtgagagcttgggaaacttacttctctcaatcataggtttttcatctgcaaaagaagaataaataataaaacaggattggaagagaatgaaacaatgcagtgtccctgagtgtttagcaccgtatctggccctgaagcacttagcaattgttagcagtatttttgtgtttgtgcaaaatacggataatcagaataacatcagttggatttaataaagagtgcactgggtggccaggcatggtggctcatgcctgtaatcccagcactttgggaggccgaggagggtggatcacaaggtcaggagttcaagaccaggctggccaaggtggtgaaaccccgtctctactaaaaatacaaaaattagctgggcacggtggcaggcacctgtaatcccagctactcgggaggctgaggcaggagaatcgcttgaacccgggtggcaaaggttgcagtgagccaagatcgcgccactacactccagccctgggtgatagagtgagactctgtctc

SEQ ID NO: 101455 - DNA, 634 bp, Homo sapiens
ttctctctatggcaggaaactgcatatcttttggtgtacatgacagatggagtgctaatggaaatgcccaaaaccttcagagattgacacgctgtcattttccatttccgttcctggatctacggagtcttctaagagattttgcaatgaggagaagcactgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctttttgtaatttttcactttgagaaccaacattaattccatatgaatcaagtgttttgtaactgctattcatttattcagcaaatatttattgatcatctcttctccataagatagtgtgataaacacagtcatgaataaagttattttccac

SEQ ID NO: 101456 - DNA, 341 bp, Homo sapiens
tgactgtttccacgcagaaaatgctggcagcaatatgaaggatgaaatgggcagagtagacaactggagacggagagatgagctagacagcggtatctacagaaacttctgcagtgatgaaaatgttactcctgcaatgcccagtatggcagctacatggggccgttgagcacctgaaaggtagctagtgagaatgaggaactgaatttttatttttatttaattttagttaacctaaatttaaatggcctcatgcagttggtggctaccatattgaacacaccagctagaaagctatttcaaaattcaatgaaggatgacatgtcctaagtaaggcagga

SEQ ID NO: 101457 - DNA, 84 bp, Homo sapiens
gagtcgttttccaagccggcagctgcctgtctcctttgaagagtcttggaagcagccaccatccatcattcgcttggcatgact

SEQ ID NO: 101458 - DNA, 556 bp, Homo sapiens
aaggcattccacacactgcagcttctacctactcacctgatattcattctcaaccatgaaatcctctacctaccaaagctcctctttctttaccaataatttctatcactaaatgcaataaattttctttaattggaattttttgcttaaattatttgattataaatcagagaaactgttggaaacctaaatataagaacatatgaagaaaagtaaaatcatccataacctatcagccagaaggccactgttgttgcaggaagtcagggaccccgaatggagggaccagctgaagccatggcagaagaacgtggattgtgaagatttcatggacatttattagttccccaaattaatacttttataatttcttatgcctgtctttactgctatctttgaacataaattgtgaagatttcatggacgcttatcacctccccaatcaatacccttgtgatttcctatgcctgtctttactttaatctcttaatcccatcatttttgtaaactgaggaggatgtatttcgcctcaggaccctgtgatgattgtattaac

SEQ ID NO: 101459 - DNA, 322 bp, Homo sapiens
tttaagattgagattctttcatagattatataatgtcaaattgccaaaaatatcttaaatttcgaaagatatttataataaaagagccatatatattaaagagcccaccaataaagggctactgttctgtattagatgattataggtctaaggaaaaaaaaaacacagaaccatttaaagttactagagactgcagaattctgacacaagcctgcatcctctctgagagtctcctttctgagcagaaagcgtccacctatgccatggctgaacaatgtcagtaacaaggcataatactttctacaacatctctttccaattc

SEQ ID NO: 101460 - DNA, 412 bp, Homo sapiens
tcgactgagctggagtgtagggttgggtttgagtgagggagaagttagtttgtgctcagcgtatagaaagctgaatacaaccagagactgcttggagtcctgtcagcctggagcagctcttgctagaggaaatgaatctttgatgggtgtgctcccgaacacacatgattcagtgagccaagtgcatacagctgagcagacccaaggaaaggcgagtgggtggaacctcaagaatgctgtgacgagggccggatgcacacctgccttcagcctttccccagtggtggtggtgatgtttgatgttcgcagagtgaggtgtgggagagtggaaagctcccagatacacgcatgagcggcaatgactagctgggtcctgtgggttccaccgcagcttgaccacagcaaagctgta

SEQ ID NO: 101461 - DNA, 564 bp, Homo sapiens
tcttgattccaggggtatagaacacttagtgactgtatttagcagtgcatgagaagttgggtttgaaaatactgagataatgcttcttagtccaaaacaaacaaaaaatattaggtatatcagagtacttagcagacagttgtcacagcagtattttgatttaaagattaggaaaattactagttagtgtccactcaagtggtaaaacgaagagatatgagatgcttgaatgacttttgagtgtcatttgggctctttcttcctgtatacatttattattttcaaaatccacacttccgaaaccttcactgagcttccgctttatgccaagtacagttacgaggtgttaagtaaataacaattaattccttcagataatgcttgtgtttctaggtgccaggcactgtccaggggccattgtccgggtcctttttcatgtaccttgatctaatttggggggaaagaaaacgtgtaagataacaaactaacacattaataggtataatcccagtaatgagagcaataatgataatttcaataaagttatgtgatgaggtggggctg

SEQ ID NO: 101462 - DNA, 572 bp, Homo sapiens
agctctgggacagcccactggaaagcttcaatacagctgtggaaatctgcaccctagaagatcctagtacagaaattctacaaccaaccataatcatggaagagccaacttccagcaccaacgagaataaaatgaagagcccctgtgaatctaacaaaagaaaagttgacaagaagaagaatctgcacagagcctcagcccctgaacagagtttgaaagagacagaaaaagcaaaatatccaacattagtgttttactgcaggaagaataagaaaagaaattcaaatcaactggagaataaccagcctacagagagctccactgatccaatcaaagagaaaggagacctagacatatctgcaggatctccacaggatggagaggaagaaaaggatttggtgttccttggagcacgtgcatgtttagaagagcacataagaagatctgtattgtatgtaggtgacagtgacactctttccaaaatgaagacatcagaatcaccaccttcaggccacatacctcagagtggtgtgttttgtaactcacccaatgctgtgagcaactgaaggtcc

SEQ ID NO: 101463 - DNA, 1030 bp, Homo sapiens
gcaagtgggtgggtgaaaaggaatagaagcagagaaaatcaggaaatgcttatatatagcaaaaacaaaatacccatctggaaaatatccaaaaaatgactgcagactctcttagttggcaatgccaaatgctttagaaattattcatgtgttaaattcagttatgccagttctcactaactactttatatccatgtctgtggggaattcttgcagagggcattgttcagctattagaattactggggtggcagttccccttttcccagttcattgtggaccaaactacaggctcttctgatcttactgctttctgaagcagccagcagcgtagataattccttgacttgttttatttaaaaaatatcactggagatttagtaggagtgttgtatcacaccaattctcattctgttttcaaccaaggattctggagtactctgatagcattggtttcatttctcatgtcgtcctggcaagcataattttgtagtttatctcagtttcaggtagaagctgcagaagcagagagcagcctacccacaaaaggggtccagttggttctctagcccctgagctgagtggcaggcagtctatatgtttgctcatctctgcactgtgcctggtgctgtgcttagaggagaagcaaaggaaggagcgtgtagtccaagtggaaagccaggatagacagctggtaaaactcgcccatctcttgccttccttcttgccttctggataattgtgtttttgcaatagcttctcatttcccttctaaagaagaaaagcaaaaagcaaaagccaaacaaatatacacatattttatatcaaagatgtttgcaaaagttgtttctgtaactcattgcttagcaatggtaccgtaggggaattttcatactgggctacagaatacttatgcatttttgtagtttatttaaaattctctaaagaggcaatgtgttaaaggaatcctaaagtaagtctttgtataaagcaaatggtccttccctcattaaagtgtatttcttcttaa

SEQ ID NO: 101464 - DNA, 848 bp, Homo sapiens
gaagacagccagcctgtgagactagaagcaagagggcatgagtcatgctagcgttctctcactgtcataatatttgcaaaggtgttttcattgatgggtcaaaaagtgcaaaggtttgaggagacagggcaaccaaatgtaatgtggtattatagaggccaggggaaaacttcccctttgccctctgaaggtttgctgaaatcaattgatgaaaggcagaaaaggcatacaaatgtattaatgtggtggaatcacaaagggattcccccaatcttccaatgggtacagcttatataccctttttcataggggagggaagcgctgggggatatagacaattctttgaggggcagtaaatgactattagggagaatggacggaccagggaacagtaattaacttgtaaaggattttctctggaattttctctgagctccagtggcaggaattatcttcttaaaaacaagtctgtccaggtgtggttgcattcttgtcttttttctgcaatagataatgccattttaggaagcagatagaaggcaatttttttttttttgtaagagacttttttgaacagatgaggaaactccagccgggggcacagagcaagatctccatctcaaaaacaagacaacaagcaacaaaagatttcatgtgtgatatagctcatattattcatatgtagttacatatatactcaacacataaccacattggaaatggactactaccggtccatggctgggaaggttgtcccacatgggaatggggccaaaatcagtttggctaataacccacaacatgattttcatgaccactttggatggcaagcttagcaacgacacata

SEQ ID NO: 101465 - DNA, 482 bp, Homo sapiens
gggaaggacaggtcaacagctggaggtgtgagcatctgaggctcagagccagaataggccaggagtcgggtgaagggggaaggccttcacatgctggaggaagttcccagccaagactaactcacttcctcttctgagacgccaggtatctgggcagtctggaagaggaaatgatgaatgagttgttgaaaaaaaatggtcaaacccagggaatctcagatgccctttctcattcttgggctgcatcgactagacaaaaatgtagcccaagaattccacctcgggctccaggtgctgcagttctcagggaggtgtcggggaactgaggaccagaccagaagtctctgtaggatgtctgatctcctctggcaggaaggccattggtgggagtgtttccactaaaaccaagagagctgaagagttgagagttgaatgaggtggggtgggaagagggggcaggacaaaagtctgagtaccaggtg

SEQ ID NO: 101466 - DNA, 344 bp, Homo sapiens
cagctcacttcaacttccgcctcccgggttctggagatattctgcttcagttttctgagtagctgggattacaggtgcccaccacgacacctggctaattttttgtatttttagtagagacaggatttcaccttgttggccaggctggtctcaaactcctgacctcaggtgatccacccgcctcagcctcccaaagtgctggtattacaggcgtgagccaccttgcctggccaaagcgtgaacatcttaagaaccagtcttgatctggcaaaaaagtagtagaatactacttttctttatttgtccctaaaaataaagtatgtacatctgttcacaaggaagaa

SEQ ID NO: 101467 - DNA, 385 bp, Homo sapiens
aagcagtgcaggctttattccaatggccgtggaattggataactgggagcatagctcgcaaatcaacttctcggctcctgagaactgggaagttacagatatagggtatctttaatgaaggtatggggcattaagaacaagcagaagaatagtcatgctttttcttggaaagggacggagattttcttggaatcaaggagagtcctcttttttgttcttttttggcatcttccgaaaaaggtgattcacggtgattgtcaagtgtcatggcaccagtgggagtgtcatttagtgtgaaaattggataataatgaagctagaggtccttcagaggtcaaataagctgcctaagaggtaacctctgaccacagacatcctgtttcct

SEQ ID NO: 101468 - DNA, 659 bp, Homo sapiens
atctgcatttgtacatttattacagctcttttcacaagggcaaagttatggaatcaacgtaagtgtgcatcagtggatgagtgaataaagaaaatgtggtatgtataccatggaacaaagccatagaaaggaacaaaactatgtcttttgcagcaacgtggatagagctggaagccattatcctaagtaaaataatgagaaacaaaatataaaatacatgttcctacttacaagtaggagctaagaaattggtatctatggaaataaacaaggaaataatagacactggggactccagaaaggagcagagtaggagagaagtgaggatttaaaaattaagtattggggataatgttcactatttaggtggtgagtatactagaagccgaaaccctagtattatgtatgtatccatgtaacaaaactgcacttgtaccccctaaatctatgcaaagaaaaaaatatataagtagaaaatacatatttctgaatccaggttggtataaaaattattaaataaacaaatgaagaaaagactaactttccatatacaagaatttaaaattttctctggagatatgttgtccttaaggagatgcagcgtaactccccaatccttaagtatgagcgtgcgtggtgacttgctttgaagaagtact

SEQ ID NO: 101469 - DNA, 572 bp, Homo sapiens
tctccttgttttacctatgaagaaactgaggctcagggaaaaaaaacggagttgtccagggtcactcaactagtggtagagccagaaccaaggtaggacttctgcagtgttctttccagtattccaggctgcttaagacgtacagggtctggcacatggtaagcccttaataagtatttgtggaaatgagttatatatagtttgtgcctctgagaaacttactgtctagttaaggtaattaaggcaaaaaacaaaactgccatgctgatcagtagtgggattgcgcctgtgaaaagccaccgcactccagcctgggctacatagcaagatccccatctcttaaaaaaaaagaaaaaaattgataagacaagctgttataaggcttgcgtatgataacattatagaatttcaaagatgagggagaattctcttcaaacatttattccacaaatatatattgagttcctgctatgtgctaaactcttttggcccctagggatacagcaaggaacaagatagaccaaatcccttccctcatgtagtgtatgttctggtggggagagatagacagc

SEQ ID NO: 101470 - DNA, 613 bp, Homo sapiens
atccttcccttctcacgaaagcctgttttcaatttcatcattctttaattcacaaatggctcacacatgtaactccagcattctgggaggtcaagactggaggactgtttgaagccaggagtttgagaccagctaaaacttgatcaagtccttcaattttgttgaaaactacagagagaaatatgcctgacttatgaaaagatgctacccagtcattgatatcactgccttctcaccaacattctgatttgtctctctggtggtgtggaaggcctctcaccacaatgtactatttgggatgtctggctaatgtgcctttctttgtaaagtggaaggtagaaaatatgaaagatcaatcgtagaatctagaaagcccccttagaaatacctatgggctttcattattttatttcacccttactgcatacaccattaactctagcactgactgtggttatttcatccatcaagtcttatctgtttggttacctgcaagttccctgaaagcaagataaaggtcttaacctcttcttaaaatcctagagcctacatctcagtgttaggtgcatgtaagactcccagcaaatgtttactgaatgaatatgtaaatatg

SEQ ID NO: 101471 - DNA, 555 bp, Homo sapiens
cactcaggctggagcgcagcggtgtgatctcagctcactgcagcctccaacctcccaggctcaagggatcctcccaccttagccttccaagtagctgggaccacaggcacctgtcaccatgcccagctaattttttgtatttttggtaaagacaaggtttcactatgttgcccaggttgatctcaaactcataagctcaggtgatctgcctgccttggcctcccaaagtgctgagattacaggtgtgagccagcacacctggccaaaaggctttatcttatttaacctaataacacatagaaataggtactgttattatccccattttgttgatgaggaaatgaaggattataaagccttatttagattaaatagttaccaagaagctgagccaggctttgaactcttgagctaatattcacagtttaatttgactaggactataagtgtggtagaaagctgaggcatctgaaggttttatgtgtcacattggaccatgagccaaattcagtttcaccagatatcaaagacccaggctaggtacaaggcccagaa

SEQ ID NO: 101472 - DNA, 307 bp, Homo sapiens
atattatgaacaccttattttgtgacagttttgtatagaaactcatctttaccaagtttttctaaatcatcccatttaatgttcatggaaacaacagctctttctttttcactctgtttcattggtttatttactgtttaagttttaaagtacagtaacattacaatggcatgaacaggcttgggaatgaatacagctgactcatagtaagcataagcattctggaaaatatccaactagcaatggggattcagtatgccctggcttcagtcagtaagccttacagagggaaggagaacttgaattc

SEQ ID NO: 101473 - DNA, 314 bp, Homo sapiens
tttacaatcattagctcctttaatcctccatctccctgtgaggtcaagaccattatgcccacctcattgcaaattaaaaagtgaggctcaggctgggcgtggtggttcacgcctgtaatcccagccctttgggaggccaaggcgggtggatcacctgaggtcgggagttcgaggccagcctaaccaacatggagaaactccgtctctactaaaaatacaaaattagctggtcgtggtggtgcatgcctgtaatcccagctactcgggaggctgaggcaggagagttgcttgcttgaacccgggaggcggaggtt

SEQ ID NO: 101474 - DNA, 423 bp, Homo sapiens
gaaaaacatctctgccacgttcccagcaatgaaatgaccacagtacactctccctcgttcttaggagcaggagaaacaccttctcctcggactcccaaaagcaaatacgacacctcaagtcctcctaacagcggggacggggaccgtggagggaaatatgttgagccctgggcatgcagcctgaccgtcacttttgcaacctgagctgaaaagaggagcagattttgaggtgttcaactccgggaaagcccagacaggttcacctggtgggcgccccagtaaggcgtctgcattctttttaaggttcatccctattaagccgggcacccaggtcaaatcttccctctttcccctaccccagactcttcgcattaaaaaaacgatgacgacacagggttttgcttagcgggctgaggttgcaac

SEQ ID NO: 101475 - DNA, 1275 bp, Homo sapiens
ttacttaaaattttaaagtttttaaaaaagtaatagtgttgtatttttttaaagggcttaaatgcttaaaaaatctagttaaacttacactcttccttggaaaactgaactttaaaacaaagaagtaaggaaataatgtcagactagctaaaggaagtaccacaaaattcaagtatgtttcttaaaagacactaacagatgtttgttcatgccttatcaatttttatttaacatttaatcctaacatgtagctatttggtttcaaaaccaaaggcagatggtagaaatggtgatttagaatggtggaagatagactgctataaatgtgttggactaacggtaagcactgatgatgaaaacaaaaggagacagaaaaactattagaactagactcaaaaattgtaaaccttaccatgagggcctctatatatcagtaagtccctaagctattgtataatccagcaaaaacatagtattaaaaattatttaccaagtcaaaagactataaagcatcaaactgaggtaaaatgtgcttattaaggaaggttgtaaaactaattacagattgggtcagaaggaaagtctagttcatttacacaaatatgaattgtacagagacattcttggacccaaagatattatttaaaatgaagctcaggccaggcacggtggatcatgggctataatcccagcactttggaaggcttaggcaggaggataacctgagctcaggaatttgagaccagcctaggcaactagtgagacactgtttctgtttctacaaaaaaatagaaaaattagccgagtgtggcagcacatgcttgtagaccctgctactcaggaggctggggtgggaggatggcttgaactcgagaggtagaggccacaattagctgtgattgtgccactgtaccacaggttgggtgacagagtgggaccctgtctcaaaagaaaagaaaaataaataaattgaatcaagaattagagctgttggatctatcaataatagaatgaaaattatgaagaaagttatcaaagggctaccctccaaaggctctggggtcatttatagaaacaagcgtattaagtcatctaaggaaggcattacacactctttatagttttacagagcataaaagaagccaggaagcttgagtttattttacatagtgagtacatttctactaatattttacaatgaaattgcacaaaatgaaaaagaagccatcctctaagtatggttgtaaaatccaaaattaaattgctgttactaag

SEQ ID NO: 101476 - DNA, 630 bp, Homo sapiens
gagaaatcaaaacaagtataaacagtaaaaacaatgctaatactattaataggctatactcagatgcaaataagtatctgtactgtatttacattatcaaagtggaaaatgagaacatgaataagaaattcaactcatgatactaaaacaacaaaacaaatatatggagaggatgtaaataatacacatataaattgagacgaagtctgactctgtcacccaggctggagtgcagtggcatgaccttggctcactgcagcctctgcctctcgggttcaagtgattctcctgcctcagcctcctgagtagcccactgccgtgcctgactaattttttttttctaaatttttagtagagatggggtttcaccatgttggtcaagctggtcttgaactcctgacctcaggtgatacacccacctcggtctcccaaagtgctgggattacaggtgtgagccaccatgcctggtcctatgtagccattttttaggggaaggtcaaaatagacttcttgaaaatttaatgaaaaagagaacaataatgttgtaatggctttccagagttagatataacttgtggtaatggcttagaaattgcagatgaaatggatgagtttctagaagaaatatag

SEQ ID NO: 101477 - DNA, 766 bp, Homo sapiens
cctgtaagaagtgcctttcacctaccgccatgattctgaggtctctccagccatgtggaactagtctcactccgtcacccaggctagagctcagtggcataatctccactcaccacaatctcccagggattcaagcaattcccctgccttggcctcctgagaagctgcagacactcaatgccagactgtgaaatcagccaggagggagactgtccctgcaaagcccaggggcagagctgcccaagaccatgggaacccaccatttgcatcagcgtgacctgaatatgagacctagagtcaaaggagatcatttcggagctttaaaatttgactgccctgctggatttcgggcttgcatggaccctataacccatttgtttggccaatttctcccatttggaatagctagatttacccaatacctgtatgcccattgcatctaggaagtaactagcttgctttcgattttacaggcttatatgtggaagggacttgacttttctcaggtgagacttcggactgtagacgtttgggttaatgctgaaaagagttaagactttgtgggacttttggaaaggcatgattggttttgaaatgtgaggacatgagatttgcgggggcgggcaggggcagaatgatatggtttggctgtgtcaccacccaaatgtcatcttgaattgtatctcccagaattcccacatgttgtgagagggtctctaggggaggtgtctaatcatgaggggcagtctttctcatgctattctca

SEQ ID NO: 101478 - DNA, 149 bp, Homo sapiens
cattcttatggggagacttgtgcccattttatggacgagtaaattgaggccgagggacgttgctgggaaaacatggaaggtgcttgggttcaacttggtgtctcaacttcagcagtggcactggctggtttctttagatttacttcaag

SEQ ID NO: 101479 - DNA, 338 bp, Homo sapiens
gtagggattgcttgaaagagaattaacagcaagaggaaaccctagtggatgaaattgaaaaaacaaaatcaagaatgtctgaagttaatgaagaattgaatcttattagaagtgaattgcagaatgctgggattgatacccatgagggaaaacgtcagcaaaagagagcagaggttctggaacaccttaaaagactgtacccagattctgtggtaatgagaatgaatagttaatttaaacaaaaaaactaagctttcctgtttgctttcaacagtatcttctcatttgggattagaaatattaccattattacaaagcaatattatttcagaccatct

SEQ ID NO: 101480 - DNA, 442 bp, Homo sapiens
gcaggtgccccacctgttaggagcctccccacactgaaaggctgcctccctcctttcccaaaaaagaaatccggagtgtattggcccttttctacagaagtccaagggaaatgactcagggagaatcctagcagaggttgaatccaatgctctgatttatactgtgtctcggtggccacctccgatggatgtgtcatctcagacctgttgcagccggagcctcaagtccaatatcagatgaagctgaacccacaattcggccaccgcctccttccagagtttcagatggccaggtgggcagaggcgggcagtgcagagaccccagacgtgccggccctgtcctccctaccttctcaagattaggaaggggtgctggaggggacaggggcagcttgggagtggtgaggaagctcctagattcggggctcatcccctggggcct

SEQ ID NO: 101481 - DNA, 1675 bp, Homo sapiens
cagctaccatatgatccagttaattctactagtgcttatatatccgaggaaaatgaaatcagaggctgggcacagtggcacacgcctgtaatcccagcactttgggaggctgaggcgggcggatcacgaggtcaggagtttgagaccagcctgaccaacatggtgaaaccccatctctactaaaaatgctaaaattagccaggtgtggtggcatgcatctgtagtcccagctactcagggggctgaggcaggggaatcacttgaacctgggaggcagaggttgcatcactgcattccaacctgggcaacagaacaagactccccgtctcccccacaaaaaaaaaaaaagaaaagaaaatgaaatcagtagcaatatctgcattcccatgttcattgcagcactattcataatagccaggatacgggatcagcctaagtgtcaacagatgaatgaataaagaaaatatgagatatatatatatatacatacatacacacacagtggaaaattataatcctgtcattgtgacaacatggatgaacctggaggacataatgttaagtgaaataggccaggcacagaaagataaatactacaggatcttacttatatgtgcaatataaaaaagttgaactcatagtagagaatagaatggtgattaccacgggctagacggggagagggaaagttggggaaatgttagtcaaagcatataaaatttcagacaggaagaataagttcaagagatctgttgtacaacatggtgactatagttaataacgatgtactatatacttgaaaattgctaagagtaggttttaagtgttcttactacaaaaaaaaatgaagtcatacatatgttaatcagctcagtttaggtattccacaacacatacatatttcaaaataatgtgcagaattacatacaatttttatcaattaaaaaacacttaaaaaaattcatacagaccacttgtaaaataacgttttgagttaaccagggaaattttattttaaatagataattagattataccaaagaattattaattttacgtgtaaaatggaattgtgattatggaaaagtcttgtttttagaaatgcatactgagctatatgggggtaatggtatataaaatctgggatttatttttaaatataaaaaataagagagtgactaaatgatgggtatatacacacttaccatactggttatctctatttttaatcatatttaagaaagaaataacagtactgtctttcactggactggcacataactgtccttaaaacgcctgccattaaaagaatattggaaacaaaaagtaaactgcctattgatttcactatgatgatctgacctggataaagaaaatgtgaaaaatcggccaggcgtgagccaccacaccagcctctttttttcttattaaagtgaaattcacataatgttaaattaacaattttaaagtatgcaattcaatggcacagtacattcacaatgttgttaaactatcaccaagcatattcatcaccccagaagaaaatcttgtacccaattagcagtcaccctcattttcccctgcccccagccccagcaaatgccaatcagcattctgtctctatggatatactttttctgtacatttcatataaacagaattatatctattgtga

SEQ ID NO: 101482 - DNA, 673 bp, Homo sapiens
cagctaccatatgatccagttaattctactagtgcttatatatccgaggaaaatgaaatcagaggctgggcacagtggcacacgcctgtaatcccagcactttgggaggctgaggcgggcggatcacgaggtcaggagtttgagaccagcctgaccaacatggtgaaaccccatctctactaaaaatgctaaaattagccaggtgtggtggcatgcatctgtagtcccagctactcagggggctgaggcaggggaatcacttgaacctgggaggcagaggttgcatcactgcattccaacctgggcaacagaacaagactccccgtctcccccacaaaaaaaaaaaaagaaaagaaaatgaaatcagtagcaatatctgcattcccatgttcattgcagcactattcataatagccaggatacgggatcagcctaagtgtcaacagatgaatgaataaagaaaatatgagatatatatatatatacatacacacacacacctggtttttaaaacaacactgtcatctaccctcatagtcattgtcaaactacactcagatttgctttttcactgattattgtgtaggtaaattctgtaaaagtgctgttacatgaagtcttatgctttgagaagcctaaaaggaaaacacatttatggaaaggtttttatacc

SEQ ID NO: 101483 - DNA, 1667 bp, Homo sapiens
cagctaccatatgatccagttaattctactagtgcttatatatccgaggaaaatgaaatcagaggctgggcacagtggcacacgcctgtaatcccagcactttgggaggctgaggcgggcggatcacgaggtcaggagtttgagaccagcctgaccaacatggtgaaaccccatctctactaaaaatgctaaaattagccaggtgtggtggcatgcatctgtagtcccagctactcagggggctgaggcaggggaatcacttgaacctgggaggcagaggttgcatcactgcattccaacctgggcaacagaacaagactccccgtctcccccacaaaaaaaaaaaaagaaaagaaaatgaaatcagtagcaatatctgcattcccatgttcattgcagcactattcataatagccaggatacgggatcagcctaagtgtcaacagatgaatgaataaagaaaatatgagatatatatatatatacatacatacacacacagtggaaaattataatcctgtcattgtgacaacatggatgaacctggaggacataatgttaagtgaaataggccaggcacagaaagataaatactacaggatcttacttatatgtgcaatataaaaaagttgaactcatagtagagaatagaatggtgattaccacgggctagacggggagagggaaagttggggaaatgttagtcaaagcatataaaatttcagacaggaagaataagttcaagagatctgttgtacaacatggtgactatagttaataacgatgtactatatacttgaaaattgctaagagtaggttttaagtgttcttactacaaaaaaaaatgaagtcatacatatgttaatcagctcagtttaggtattccacaacacatacatatttcaaaataatgtgcagaattacatacaatttttatcaattaaaaaacacttaaaaaaattcatacagaccacttgtaaaataacgttttgagttaaccagggaaattttattttaaatagataattagattataccaaagaattattaattttacgtgtaaaatggaattgtgattatggaaaagtcttgtttttagaaatgcatactgagctatatgggggtaatggtatataaaatctgggatttatttttaaatataaaaaataagagagtgactaaatgatgggtatatacacacttaccatactggttatctctatttttaatcatatttaagaaagaaataacagtactgtctttcactggactggcacataactgtccttaaaacgcctgccattaaaagaatattggaaacaaaaagtaaactgcctattgatttcactatgatgatctgacctggataaagaaaatgtgaaaaatcggccaggcacgtgggtcacgcctgtaatcctaaaactttgggaggccgaggcaggtggatcacctgaggtcaggaatccgagaccagcctggccaacatggtgaaaccccgtctctactaaaatacaaaaaaatcagccaggcatggtggcaggcgcctgtaatcccagctactcaggaggctgaggcaagagaattgcttgaacccgggaggcggaggttgcagtaagctgagattgtgcccactgcactccagcctgggcaaggagcaagactgtctt

SEQ ID NO: 101484 - DNA, 549 bp, Homo sapiens
atgacgaggtctgtttgaattctccttcacttcgggcactaggctggctgtaaatcacgaagtcaggaggagataagaaagacaaaaaatagatccaagtaaacgtgagaatttagcacgataaagagagcagaatcaattagtggaaataaggtgaattattcaataaaattatgttgggaccagatagccatatggaaaagaaaattatgttggcccaatcaatcatcatttggccacgttgtggcctgttataactccagttccacagggctccaaaggcaaccatgcagttcatctgcaactcttcacaagagcccagaaaatatcagctcttaggattagccttcaccttatgccaagacaaacacatttaaaaacaagacatactttgggatgccgaggaaggcagatcacgaggtcaggagttcaagaccagcctggctgatatggtgaaaccccatctctactaaaaatacaaaaattagccaggcgtggtggcacgcacctgtaaacccagctactcgggaggctgggacaggagaatcg

SEQ ID NO: 101485 - DNA, 157 bp, Homo sapiens
agggaagatcactaagcctctcacagagtctgtcactcaggctgcagcacagtggcacaatcacggcttactgcagccttgacttgcaggctcaggtgatccacccacttcagcctcctgagtagctgggattataggcacgtgccaccatgtctgg

SEQ ID NO: 101486 - DNA, 138 bp, Homo sapiens
ttgtcacccatagaaaattatctccccacattatctgacattctgccaaaaatgatactattttctgttactggatttgctgctatctatcctgtaagctctttcttcactgcttctcgggtttccattaattttttt

SEQ ID NO: 101487 - DNA, 340 bp, Homo sapiens
cttaagggccaaggcagagaaatgccacaggggcagaggcaccagagagtttccactaaagcaatgctcagtggtgcctagtgggccactacagagagtccccactagggtaatgtccattggatccatgggagcaggggtgaccccaagaacccagaactctagagctagggccaccagcatgtaactgtacactgggagagccacaggcacaagactctacttgggagagcttcagtatggctgtgccaagcaaagccatggcagcaaggttgcctggagccttggcaacccaacttctaccccagggtgtccagagggcaggacatggaataaagga

SEQ ID NO: 101488 - DNA, 322 bp, Homo sapiens
ctggtaacctgactgtgctgtttactaaacattaccaagcatgtcgggcgcggtggttcatgcctgtaatcccagcactttgggaggccgaggcgggcagatcacgaggtcaggagatcgagaccatcctggctaatatggtgaagccccatttctactaaaaatacaaaaaattagccaggcgtggtggtgggcacctgtagtcccagctactcaggaggctgaggcaggagaatggcgtgaacccgggaggcggagcttgcagtgagccgagatcatgccattgcactccagcctgggcaacagagtgagactccatctc

SEQ ID NO: 101489 - DNA, 803 bp, Homo sapiens
gcagactgggaacaagaagacctgcagggtcaactgacatgaggaactacttcccccttgaaaatgcaagaagaaccagtctcggcataaggtagacacctaatatagcagaggagaaggtcagaaataacagaaggtttgcatgaaattattgaatcaaagctcaccaaacatcttggtcattagttttatgagacagtaaaccacgatactatcatcagtgttttttgtttctgatatggtttggctgtgtgtccccactcaatgccagcccgtgaaagcagctgggagggaggctataccctgcaaagccacaggggcggagctgcccaagaccatgggaaaccacctcttgcatcagcatgacctggatatgagacatggagtcaaaggagatcattttggagcttaagatttgactgccctgctggatttcagacatgcatggggcctgtagcccctttgtttcagccaattcctcccatttggaatggctgtattcacccaatgcctgtattcactcaatgcctgtatccccattgtatctaggaagtaactaactcgcttttgattttacagctcataggcagaaggtatttgccttgtctcagatgagactttggactgcggacttttgagttaatgctgaaatgagttaagactttaggggactgttgggaaggcatgactgttttcgaaatgtgaggacatgagatttgggaggggtcagggtggaatgctatggtttggctctgtgtccccacccagatctcgaattgtactcccataattcccacgtgttg

SEQ ID NO: 101490 - DNA, 301 bp, Homo sapiens
agaaagagaacgtggattactcatgtcccagtaaatgtttaaaaagtccattttattgttcccatataaatatatttacaaattatcagaattttcatcatcaattgctttttcctttcaattattaactttagaaatttatataatttttggaatttatcaaaataaaaaattccaagttctgtactcatttttcggataagactatatttaaaatgtttcctgtattttatcttgtagttccctcagtgcattctttttcttctagtctcagtattttcttaccccttctgccctatat

SEQ ID NO: 101491 - DNA, 200 bp, Homo sapiens
atgttgctcaggctggccagctccgctttaattgtgggaaatgttacattgtttctttcctctttaatgtgtagcttcattccattgccctatagaattttatactaatgcattacttttatggctgaaagtgttttattgctcactttgtcatacttctctgccacacaatatatgtatgaatgaaaattaaaatattt

SEQ ID NO: 101492 - DNA, 128 bp, Homo sapiens
gaaagatttctttgtagcatgtgtgctgtttgacaacattttccctacagtacgatgtctttcaaaattggactcaatcctctcaaatcctgttgctgctttgttaacaaaatttatatattattcta

SEQ ID NO: 101493 - DNA, 484 bp, Homo sapiens
aaagatttatctgtagcttgcgatgctgtttggtacgatagcgttcacccacacaagaacttctttcaaaattgggagtgcatcctctcaaaccctgctttggttttatcaactgattttactgatattcgaagtcctttgttgtcatttcaacgatgttcacagcatctttgccagcagtagatttcatctcaagaaaccactttctgtatccacccatatgaagcaaatcctcatctgttcaagtttaatcatgagactgcagcaattcagtcagatcttcaggctccaccacttctagttatctagctatttctaccacatttgtagttacttcctccactgaagtcttgaagtcaaatcaagactcagttatctgtgaaggttggaatcaatttcttccaaactcctgttaatgctgacattttaacgtcctcccatgaagcatgatgttcttaaatggcatctagaatggtgaaccctt

SEQ ID NO: 101494 - DNA, 435 bp, Homo sapiens
tgtggactttcttttctcaagccctttcctgggcctctccttggaaacagtcattcggtcagctcaaactgtgggacacaactctttccatttataggaggcattaatgataggattgtttttaggaaacaataggaaagttcttaggtctttgtctaagacctaagaactttgtatctaagacaatgtccaattttctgtattaaccaagaaaaatttttttcttgctcaatttgtggaggttttgatttatatttaatgctgtgccaccagtcacatttggctatttaaatttattttggttaaaattaaagtaaaaattcagttccttagtcacatttcaagttctcaacactcacaaatgatgggctactgactactatgcatggtggtacagtcaaagaatatttccatcctcatagaaagttttttttt

SEQ ID NO: 101495 - DNA, 382 bp, Homo sapiens
tcctcaaggacataagagttagagaaaggcggcgaattacccactcagaacagtgccgtgaatctgaaagtcaatagccacccatataaccactggattgttagcacttaaagttgccttcgaaaaacacagttaaaaaatatactcagaagctcttgtcatccacatgccacagatgtgtgaggacatttatggtaacaacaactaacatatggatgagaatgtacagtaagtgcaggagaagcgctcagtaagtgctcgtcctgtggaaggcaggccccctttagaagtcagggcataccgacctctccaggcacatgatcctgggaagcactgctgcccttgctatgaccttcacaccctgccagtgctggtttccctg

SEQ ID NO: 101496 - DNA, 159 bp, Homo sapiens
ccctttcattggttttgaaagagctttactgcacatattatcaaacataactcagtgaacattttttgagcaccaataatgttcaagcaaataatttcaaaataacagagtattcattaagacagaagcatgccctggatgctggagaaacacttggtc

SEQ ID NO: 101497 - DNA, 367 bp, Homo sapiens
ggcatacactgacttttaacattatttagagtaaccaacctaagggaggtgacatccaagtcatgaaatcatagagtaacagaatcttggaacacaaggaacctctgggatgacctggttgtacctcctatccagcagaaggagtctaatccctagagctcaggagcttgttcatctggccccacctaaacacatctactcacaagaagctctttcccttagaggccaggctgtttctttggaaattgattttaatatctagaaactcttccttatatttgctctcttataggccttagtcacccatccaccactcctcagctggaagcagccaagaataacatcttattctaccagtgacaatcct

SEQ ID NO: 101498 - DNA, 377 bp, Homo sapiens
tacatctcttttgcccacattccaatagttagagctaaatcatatggccacacctaactgcacagaaggctgggaaatagattttagctgtgtgacttagaaggaaatgggaatcaagtctggaaattacataacactctcttgtttttgacttttttaaaattttctccctttattcccattcccaatcctatagttatttaactacataccctagtgtatttaatatatgtccttctgatctaccttctgtacagacaataaccatttataaacatgtccaaaaaaaaactacacagaactcttaggtatacttgaaagatatcataaaaatctaattacaaaagtacaagaagattactgactcccagatccat

SEQ ID NO: 101499 - DNA, 125 bp, Homo sapiens
agggaagtagggggacgataggggctgggtgggggcggtcagaggcaagtacgtgcagctggcaggggccctgcgcgggcgggggtgcgccctccccgcagttcgcgcaggtggaccggagaccc

SEQ ID NO: 101500 - DNA, 437 bp, Homo sapiens
ggcggtggagaaatagaccacatttcttgattgaagaagctgcaaaatcacattgcaaagcagtgtagatacagggtatgttgaaagttgtggccatttttgcaatgtcacagtcatagagaaaattgaagaattttaagcagggaattgatataattggattggacttatagaaacatgatttttacagaggtgtggaaaatggataaatgaggacaaatttggagggaaagagaggttagaaggataattcattaattcaattgagaaatattgtcagactgatctatggctagtgttagcgaaaaaagagaagatgaagtaattttgaatgataaaggaggtagaggcttgatgaatattcagttctgggaaataagggacccagagaagtaaagtatggctccaatattctgactttgtaaactcagaaatca

SEQ ID NO: 101501 - DNA, 382 bp, Homo sapiens
tgagacagagtcttgctctgttgcccaggctggagtgcggcggcgtgatcttggctcactgcaagctccacctcccaggttcacgccattctcctgcctcagcctcccgagtagctgggactacaggcacccgccaccacgcccggttaattttttgtactttttagtacagacagggtttcactgtgttagccaggatggtcttgatctcctgacctcgtgatccacccgccttggcctcccagagtgctgggattacaggcgtgagccaccacgcccggcctacagtatcttctttcaagttctttcaaccttgttacttaagatctaaattaagtccataatgaggcatctgagtgtagccttagactctatacagatg

SEQ ID NO: 101502 - DNA, 389 bp, Homo sapiens
cagttcactattagtcttccacatttcctcttcactatggcatctattcacctggcctcattcactgaggacttttacatgacccgttgttcctctcagtaacttcaatactgacctgttggttccttgacttcctcaactccaataatcatttcacttcagccacccaccactacgattacaccctagaccttatcactaccagtaactgttctactttcaaaatttcacttcaagcatctcattctctaacaccttacttactctagtattcccattgcaaaaatcctctggggtcagtggtatctctctaattcgctgactactttttccctatccatgaccccctcctgtttttactcaggtcctcaccttcaattcatgatctg

SEQ ID NO: 101503 - DNA, 482 bp, Homo sapiens
attttgttttgcggtgcctttccactggtctataagaaacgtgacataaggactacgtctgattcgattctgactccccagcacccaattaaatggcagccaatgtcattcttttttttggaaacaaggtcttgctctgctgcccaggctggaatgcagtggcatgatcttggctcactgcagactccacctaccaggttctagtgattctcctgcctcagcctcctgagtggctgggattgcgggcgcctaccaccacactggctaattttcgtatttttggtggagatggagtttcaccatgtgggtcaggctggtctcaaactcctgacctcaggagaatctgcctgcctcgggctcccaaaagtgtgggattataggcgtgagccactgcgcctgtccatggatccttccaaagtcttcaaatctctcccacatccgggcttcatcctcccctgcctgtctccatgcctttccggtgt

SEQ ID NO: 101504 - DNA, 213 bp, Homo sapiens
atcgggctgtgcgtgaacatgcggagcctgccctggtacgtcccggccaaccccgactccttcttcccacgctgctacagcctctgcaccgagagtgagcagcaggagttcctggaagacttccggcgcaccatggcatccagcatcctcaagtgggtggtcagccaccagagctgcagcaggagcagcagaagcaagcccagggaccagagg

SEQ ID NO: 101505 - DNA, 140 bp, Homo sapiens
gtgtcatgcaagcattttgtatgcggagcttcattgaaatctcacatcaacctgataggaagatatcatcacgcctactttatcgacaggaaaactaaaatctccaagaagggaagtgacttgaccaagggaaccgattg

SEQ ID NO: 101506 - DNA, 176 bp, Homo sapiens
tgtcttctactgaatatttgggaaatgttaatgctagtcatctaactgttaaaatcaaactcttttaccctatgtagttctcattaaatgatgttgatgattttatacaaatgtgttgacattttaccatattatgtttttaacagggtataaacttcagactatatatatatata

SEQ ID NO: 101507 - DNA, 463 bp, Homo sapiens
aacagatagctagaaagacagagaaaatagttggattgaccttttaaaaaatggtggagacatcagagcatattgagaggtggaaaggaaggagtacacagggaagggcctaggaaaaatggtaaagacaaagaaaataatgagggacacaaaacccttgcattctggaggagaaaggcaggaataaatagggcctaagatacaggtgaacaaatggctttggggacaaaaagataaccctctttctcagaaactgggagaaggatgaaaagactgagatattgatctgtggatgtaaagttatgagtaattacttgactctccaatttattttgaacctgttgtaaaatgccccagattttatagttttatcctcaggaaaatagccatagacaacctaaggtaaactgcgaatatccagccatccacaaggtatataccaaaacctggcagagacacaaca

SEQ ID NO: 101508 - DNA, 436 bp, Homo sapiens
aatggaaccctgtctagaatgccagactctctgctgaccattctctctggtcagaactggatcactttatttgatgtaaattgtatttgatttatttttttcttttttaagagatgaagtctcactatgctgcccaggctggtctcaaactcctgggctcgagtggcccttccgcctcagcgtcccaaagtgctgggattacacgtgtgagccacagcactggccataaattgtatttgatttttacagctacctgtatttagccatgtgaaagtgattttccacttatgtcagagatacaaagtttcgtttagggataaattgtaaaaaagaatataggcctgggtggtggctcatgcttttaattcccatactcagcttgagtaccggaaccaagactagtcgaggcaacatagtgaacctcatttctttaaaa

SEQ ID NO: 101509 - DNA, 446 bp, Homo sapiens
catggattgaaagactcaatattgttaatatgtaattctccctaaattgatctacagattcaatataatcccaattgaaatccaagcaagctttttttaaaaatagaaattaacaatctgattgtaaaatgtatgtgaaaacacaaaagacctatgaacaaagttggataacttacactgtgcaatttcaatacttaactaaaaagctacaataatcaagacatggaatcggccaacatacaatcatatagtccagtgggagagcatatggaaagtctacatatagacacatatggtcaattgattgttggcacaagtgccaagataattctatgggaaaggacaatcttttcaactaatcatactgggactattggatatccatatagaagaaaagaacctcaaaccttatttcacctatacacaagattgaatccaatggatca

SEQ ID NO: 101510 - DNA, 350 bp, Homo sapiens
ggcctccatgatgggcctcccaatgttcttttgccctgggacagcgtgtcctccggtggcttcctgaggaagaacagctggagggtgaaagctctggcccttgcatgcctggaatgcctctgtgccaccttcctactcacccggcagtttggcgggacacaaacttcaggagggcaatgaggcgcccttaaaactggcatggccgcaggccccatggagtctgcaggtgccctggctctcacctgtccctgcattctgaggctctgctgtttctccctaagagggtctttcttacccctggtgggtccctgcagcccagagactctgcctttggcctggggccttctgaa

SEQ ID NO: 101511 - DNA, 273 bp, Homo sapiens
tgagtcccctacctttctttggcatccctacctcctgtgagttattttgttttcttcaccttactttttttttggagtgtggttatgagaggacaagaggcttccatatctcaaaatctagccatgcagacaagcagagctggcgtggggtaaaaggccgggtaactcgagggttgctggctcagcacaattaaacatagtaccgagaacggcatccctgtttcaggtaggagtctcctgtcaccaggtgagctcaaaccaaaggtctgtttg

SEQ ID NO: 101512 - DNA, 590 bp, Homo sapiens
agggtcaggacggactagaggcgagcaatcctggtggcaccaggcgttccccgacccgcccgggtcgccagctgcacggaccctgggcagatgcgcgcagcggctgcggcacacggcggggagcggctgcttggccccatcctaaggcagcagaatgcccagagctggtccctggctccaggcgcaggccgagtaggagctgggcgggcagcggcgtcgggcaggcccttccagccgggctgacaggccgctctgacccagccatcagactccgcttgcgtcctggcagcgcggaccctagggcaactttgctgcagtggccaagccgggggcggaactgacccgtacccctgaaccgagcaagcctaggagcaggtgcgccggcggcgctgtgaagcggcactcatgacaggcaggctgggcaccgccaccccgaaacctccgagggaggaccagccagcccaggttggcgctggagctgcagcgccacctgcaggccaaggagtctttttctgggaggctggagctgcagcgccacctgcaggccaaggagtctttttctgggaggctggagctgcagcgccacctgc

SEQ ID NO: 101513 - DNA, 723 bp, Homo sapiens
tgctgggtgtatgacatgcttcagttcttcttagccggggactaaacacagtggaaagtctgtttcgggaggggatggtgagttcctgtcatcctctaactcacattaaaggacaaatgagaggggcagggtggcaggtggccatggattgttgtcccaactgacttgtatcatcatcatagaaaaacaataatacagtggtccccccttatcctcggggaatatgctccaagacccccagtagatgcctggacccatgggtagtacagaacccttcatatacatatgtttttccctagccatacactacgctaagagaaagtttaatttataaatcaagcacaggccaggtgtggtggctcacgcctgtaatcccaacactttgggaggccgaggcgggtggatcatctgaggttaggagtttgagaccagcctggccaacatggtgaaaccctgtctctactgaaaatacaaaaattagccgggcgtggtggtgcgtgcctgtagtcccagctactcgggaggctgaggcgggagaattgcttaaacccgggaggcagacgttgcagtgagccgagatcgtgccactgcactccagcccaggcaacagagcaagatccatctcagtaaataaatcaataaatcaagcaaagtaggagattaacagcaataactaaagataaaataaaatgattataacaatatgccttcattactactctt

SEQ ID NO: 101514 - DNA, 196 bp, Homo sapiens
agggggcggcggcgacagcggcggccgcaagggacgcgtccggggcccgcgctcagggggagcggtagcggcttggcagctgctccccgcgcccccgcggcctagccaggggagggggcgcagcgccggggccatggatccgcgtcaggccgctgcttcccgccggcgggcccggggcggggcggacccgtccccg

SEQ ID NO: 101515 - DNA, 755 bp, Homo sapiens
tcacggctgcgtggataaaacccaaagggaatccagaatcaagctcggcctcgcaggagtttataacttttgtacttttccctcccttgtaacgaaaagctaatcgcaaacgtttctaggaacacatttttctcctgatagacgttcccaaggtggagggcgcgagaagactggcccgtggggtgaggagccccggcccgacctcagcggcgccacaaagccatgaagaggggaaataattttccaaggggctaagagttggactttctgaagccatcgaaacctgctgctaggctctcccgctggggttttgagagaggtaggtgaggagggatcaaacatctccacccgctcttgaaagaaccgccttgagctgcgcccaacttctgcaatcccggttttccccaagttcaaggggaagggccctggcgcccaatgcccagcctccccgacaacatcctcgccagggtgcgcctgccccgcgggtccgctgtccccggcgggcggccctgggttcgaggacccggcttcccggaggcgcgactctccagcaaacaagcggagctccagaaaaaacaccgacgcgaagggggtggacagagggtgggaagccgcggggttgtcgcccacccggaggcggaatgtaacgcgctgtgggaaacgtggcaggagccctgaggcggcgtctttttcctcaggcgcccgccgagggtcccgcggaaagcctcgcgggccgccctcgcggcccgcagccc

SEQ ID NO: 101516 - DNA, 387 bp, Homo sapiens
acatcctaccacacacaggacagtccccaagacaaaggactatgtggtccagaacatcaatagtgccaaggttgagaaaccccagccttgagttttatttcatttttctagtaattcatttaattatattttttaaagtttagatctatgatgagttagaaatttaaaaacaaccctggtcctttatggactgaaagagtctgcaacctccaagcacagggtggctcaggaagctagaagaggctcagtccttggacacccatcgtcttgtagtcagttaccctattatttcatcggggaggtccctgagtgactttctgatgaactccgctctgtagccataagtagcaggaccattctttccactccttgatcagatccttattg

SEQ ID NO: 101517 - DNA, 551 bp, Homo sapiens
gaaaaacccagcgtcagggtctataattccagactcccccaaaactccttataagtggactaaaaatttttttaaaatctgcctcaacacacctttactaagagtattattttcctatattttatcttatttagttcagtcaattaaacaaaagtatagcaattaaagccaggtacagtggcttactcctataatcccaacagtttgggaggccaaagtgggaggactgcttgaggacaacagttcaagacaatccagggtgacacagtgggaccctgtctccaccaaaatatatacacacacatatacatacacacacacacacacacacacaaacacacatatacatacacacgataggccaggtgcagtggctcatgcctataatcccagccatttggtaggctgaggcaggaggactgtttgagcccagaagttcaaggtcagcctgggcaacataacaagactccatctctacaaaaagaaaaaacaactttagccaggcaaggtggtacatgcctgtagtcccagctacttgggagaaggggtag

SEQ ID NO: 101518 - DNA, 155 bp, Homo sapiens
ccttcagctgctgcccctgcccgggctgggcgcgccttgctgtcctcctggctctgacaccaagtcatttggagttcacttgttttccctcgaccccccgctcttcatctgaaaagggatcagcacagattccatggttctctgacctgaagcag

SEQ ID NO: 101519 - DNA, 410 bp, Homo sapiens
ctctggattttcaggacttatctcaagtaaggtacttgttgactgaatgctctgcttgattttaataacaataaatttctcttggtggtagatgatcaagtgattgatcgtaactaccttctacctgggtaaatatgcctttcttaagctcagacacgatgttcagttggtgtgtttcagacctctctacctttgtgcatgaggcagatactgcagaaccccttcaattcagttaatgtgtattttaaggtgacttggacttagataatcgtccatagcatccttttattttactcattatttgtctgttaccaaccgaaagtttcttggaattgttcaagaattattctggaaattacatgttgatatttaatataaacatgttttaaactttagtcttttctttaaaa

SEQ ID NO: 101520 - DNA, 367 bp, Homo sapiens
gatcatttcaaaaatctgcaagtaatttggttgctcagagctaaggacacattcagtcatcgggaagcttcagtcttagagaaaccctcacaagcaagcccactgtaactcacttcatgagaccaggcagccacttagattttagcaacagaggacagtgtttattcattgtattccagggaggagacttgctttatctaacaagctgagtaggtcaacttttcttattgactgtctcccagctctttgctgcatctccgtctggtggcccctgctgcctgggctactccaccttattccaccttattcttcaaagtgcttcctgaactccagttacctacctacctggcccctcccccccattaat

SEQ ID NO: 101521 - DNA, 251 bp, Homo sapiens
agccacagatgggaccatctagttgcaggaaaccacctcagggctcccacggactctaccttatggttttccagttaataatgtggaccaaaaaagcacaactggaccaatatataaaataaacacactcctttactacaacaattcgggaaactaaattttcaatgatggaaggaatggttatatggttaaaaccaaatgctaatgttggatacatttattaattcaataaatgaatattcatttattta

SEQ ID NO: 101522 - DNA, 473 bp, Homo sapiens
caacattgtaacttccatatcaagtgtaataaagttctcatttcaggacacatttccacatttctaaagaaagtgacaataaaacatcaacagttcttggatgttgaaacatagccaaaagtgagaccatcaggagaagggcctaagaagaactagattaacaggaagaaggtgaaaaagtgataataaatcttttaatcctgccacctacacaggcgattctccacctaccagaggtgagagcatatcttactaggtcactaacagcagcaaagtctctgaagaaggttttccagttaataatgtggaccaaaaaagcacaactggaccaatatataaaataaacacactcctttactacaacaattcgggaaactaaattttcaatgatggaaggaatggttatatggttaaaaccaaatgctaatgttggatacatttattaattcaataaatgaatattcatttattta

SEQ ID NO: 101523 - DNA, 317 bp, Homo sapiens
tgtaggtctatgaacttacaaacgtactcccaaggatagtcaaaatctccctgcaagtatgcatcaaagaagagttgtaatgtctggcggcgaagttcaaggggaaaggtggaaataactgagaggatttggttttccagttaataatgtggaccaaaaaagcacaactggaccaatatataaaataaacacactcctttactacaacaattcgggaaactaaattttcaatgatggaaggaatggttatatggttaaaaccaaatgctaatgttggatacatttattaattcaataaatgaatattcatttattta

SEQ ID NO: 101524 - DNA, 238 bp, Homo sapiens
aatttgcaaatggctatgaaggttataaggacatgttacggcgatgagctaggttttccagttaataatgtggaccaaaaaagcacaactggaccaatatataaaataaacacactcctttactacaacaattcgggaaactaaattttcaatgatggaaggaatggttatatggttaaaaccaaatgctaatgttggatacatttattaattcaataaatgaatattcatttattta

SEQ ID NO: 101525 - DNA, 764 bp, Homo sapiens
tcatctcaaatgactttattagcccaaaaaagtacaaaaattattttccccacataatattaatggtgggaatcaaaatgaatcagtagatgggggatccagattggaatgctgctacaccatagtagaatccttctgggaacctacggtgggaaaggatcacttgtagcaaaaagatccagagttgtgcagagggaccacgtcagcagtgatcacttttcagtaaccgtctttttctgctgatcattttagggtcactatgaggtcagactggatggtgggagtggataccaattttttttttactgcctacatatgcttcatgagctataatttgtctttttttccaccacagatctctgtttcttttccttactttcatgcccataatttatcttacagatgtggtttaatgctttgctgatttgacatagctttcttttccatttcattgattgctacttaaagatgcacaaggctttcagggcctcacatgaatgatgagatgagatccaacgtcaagaatctgaagcaaagacacttgtggtttcaggacgtgtaaatagagcttggtgattttctgttgagtttgttgggggaatgcataatgattaggattaggtgtttttctattttaaaaagctgcttctagaggcatagaagacaattctgatacactatttaaattttccatacaaatccaggcatgtttatgcaaaagaaaaaaaacaccagtacaaaacaaacaagatatgatctgactg

SEQ ID NO: 101526 - DNA, 341 bp, Homo sapiens
tcaatgtgatcaagtcccacgttggaagtgctttcaaccatattattgtaccatgaaagggagacgggcttcagagataagatctttgaactctgcccctacctggctgtgtgatcttgaggtagtcactcaccctctctgggcctcagtttcctggttgaattacatcatcaatgcttgacctctgtgctgcacacatgggtattgatatggtgctatcgtgatacagtgctatatgatagcgtgccacaagtcggtgctacttatatttggcaaatgatttggtttttcctagtataaatctgagcagattcaacatcataaaatcaggtaagcccact

SEQ ID NO: 101527 - DNA, 1191 bp, Homo sapiens
agtgtttcagaggtcctaattaatatgataagaaaatagattttcatttttagcattatggctgatgactagatgttcagataaatcttattggtacctcatgctttaaaaatctggataagccttcaagaacatatttttgtatgggatggctaaactggtgtgaaaaggaaggaaattcttctgattccaagaacaagaaggaagtataaatctagtgggataagtgctaattcctaataacctatcattcctaatggcctatagcctgaagtttaaagggtcacacatacagggtcaggagacaaatcttgggtagagtctgagcaagaaagagggttggattcgagccccctgaatagagccatggtcttgaaagggcaactctttcaatgagtacaaaatttgtcccacagaaagaggcaataaggataaattatcttagccttggatgtgaacagaacaattaaaaagaagtctgcttcagataactcctcatcaaaagtctatactcacacagatttaaggctaggattcacagtacttatgtgactttaaaaaatctaaattgaaattttagttacaagttgtcccaggtcactagtgccccaagacagaagcaaacatatgtccttcttttaaagaggaaggaactctaaactcagaccacaaagaactcccagagttaaaattccaaggaatatgacctcaaaattagaaatcaccaaagacatgagcgtaagccaccatgagcactgtcaacagaaacaataatctgtagattcatcccacaaatactataaatattagaaactgttgagctatagactgggtatggtggctcatacctgtagccccagcactttgggaagccaaggtgggaggattgcttgagcccaggagttcgagactagcatgggcaatatggtgagaccccacctctatttaaaaaaaaaaaagaaaaagaaaaaaagtgttcagttatagaatataaaatgagtatgtttaatatgtcaaaataaatgtttttaaagacttaaaaatgataaaagaacaagaaactattaagactggaaggtagatatgaaaaacaaccaaatagaacttctagaaatgaaaaagtgtgaataataatgaaactagaaacctcaatggattagacacagctaaagaaggaattaatgaaccaga

SEQ ID NO: 101528 - DNA, 765 bp, Homo sapiens
gaaaacaagataaaagctccatgacattggtctgggcaatggttttttaaatatgatccccaaaagcacagacaacaaaagcaaaaatagacaaataatattatatcaaactaaaaagcttcacagcaaaggaaacaacagtgaagagacaacctggaaaaaatatttgcaagccacacattctgataagggtttaatatccaaaatatacaagtcaatagcaagaaaaccaagaacccaattaaaagctaggcaaaggacctgaatagacttttctcaaaaaaaagacatacaaatggtcaacatgtatatgaaaaagtgctcgacattattaaccatcagggaaatgaaagttaaaacctcaatgagatattacctcacacatggcagaatggctattatcaaagatggcagggcacagtggctgatgcctgtaatcccaacactttcggaggcctaagcagaaggatcgcttgaacccaggagttcgaaaccatcctgggcaacagagtgagtctccacaaaaaataaaaattaaccaggtatggtggcgtgcacctgtagacccagtgacttgggaggctgaggcaggaagatcacttgagcccaggagtttgaggctgcagtgagctgtgattgcaccactgcactccagcctgggtgacaaagtgaaaccatgtctcaaaaaaaaaaaaaaaatgcacaaaagttaaggtgttggcaaggaagtggagaagagggtacccttgcacactgttggtggga

SEQ ID NO: 101529 - DNA, 374 bp, Homo sapiens
aggatcatttggacaatatgggattttattagaaaagttcctatagtaggacatttgttcctaatccttttaagttagactgaagcagttttctaagttactatggaaaaataggtttctgccgggagcagtggctcacacctataatcccaacactttgggaggcagaggtaggagcccaggagttccagaccggcctgggcaacagagcgagaccctgtctctaccaaaaattcaaaaattagccaggcatggcagtgtacatctgtaatctcagcaacttgggaggctgagatgggaggattacttgagcccaggaggttgaggctgcagtgagccaaggtcgtgccactgcactccaacctgggtgacag

SEQ ID NO: 101530 - DNA, 351 bp, Homo sapiens
gcggccgcctactactactaaattcgcggccgcgtcgatgattgtggcattttgctctaaatattgtttcctccctgatttagaaagtaatttaaaatgtacatagaaacataaaccaaaaaagaatattttgtcgctttgaatatgaaaagtgatattgatatactattattgctgtactgtgatggagtatatcacaggttatggaggttatttcaatattgaaaaaatgctagttgagtatacatacattcctgcaccattgttaataaattatattctttttgatgtgttgcttagcttcttgggaccctttactcactagacttttattgacagctgtgttccaaa

SEQ ID NO: 101531 - DNA, 398 bp, Homo sapiens
ataggaaaggttgtcaagcataaatggttggggtaagaccactctgcatggtcacacattcaaagagcttgacaagagctatgcttgtgactgatcctatggaacattttaaagcaggatcttggtgtcttctctacccacacctccacagctctcctttggaggctcaccatgcccctagaggacttcacatggactcccctctctctaagcccacatcagctaaccctttcccgtggacctcccctttcataaaatgaacctgtcctgactctcatcctggaggggtgaatttgcatttccagggaagttttctggaactatgaaaaccttaccttcaaagccccatagcctcgtggaaaggcaggaaccttcctagggatgcttttttggcatcc

SEQ ID NO: 101532 - DNA, 428 bp, Homo sapiens
tctcctgtccatatcagtggtgatagagaaagtagattccatgctgaggagactgggacagtggatatgggtgaggggtggagaggagagagggtggccatcagggagagtggtggggtggaagagatttagggctgaagaaatgaagaataccatttggagctttgtttactttgatctttctgtgcaagagtagacacccagttggccattggagatggaagcctagagttaggtacaagatttaagttggagatataatttgggggtcatcgacatatatatgatacgtggttccagaatctcaatctccaggcttctttcagttcactctctcaggcttggtgctcaccctccccaaatcagggcatacaggaacttctgaatctcctgtaaaccatgcacaggtcatgaagaactaggagcac

SEQ ID NO: 101533 - DNA, 625 bp, Homo sapiens
ctcacgggtaagaaaggggtttccattattttattttattttgcattagtctttttatgcatatccttgtatgtttaaagaccatttgcattctattttctgttaactgtctgttcacatccttttgcctattcttcgggttcttctcatagtttaaaattcttcatatatagggctacaattagccctctgtgataaatgctgcaaatattttcagctatccaaaaaaatcttttttcttctctgtcacccaggctggagtgcagtggcttactgcatcctcaaactcctgggctcacagtcctcctacctcagcctcccaagtaggtggaacccaggccaggtacttaatttttttttttttttttttttggtagagccagtcctactaggttgcccaggttggttttgaattcctggtctcaagcagtccttctgcctcagcctcccaaaatgctgggattacagctgtaagccaccgtgcccaaccagaaatatattttatttatcatacatttattcaacaaatattttaaaatgctgtttaataagctagagaatattctaggtgctgaaaatgtagcagtgaccaaaacagaaaaaaaaataaccatctcattatgaa

SEQ ID NO: 101534 - DNA, 253 bp, Homo sapiens
ccattttacagaagaagaaaggaagaccctgagagataaagtaacatgttcactgtcatagaattagtgagtgacaaagtcaggatttgagcccagatctgctcagttccaaatcatctgccctattgtggatggcagatacctggtgctcctgcttttgttcctcatgccctgtgctcttggcagaaattagggcttcatgattcttaccagcttagcacttcagtagcctataccagttgattagagttgg

SEQ ID NO: 101535 - DNA, 526 bp, Homo sapiens
ctgtggagagcgtccagtggacatgggggcctataacacctgaggctgctgggcctcctctgggaggaccccaggccctggaggacaaatagaagttgtcagtggaaggagggaagatgacagggaggcaggatagtcacatggggctggaaaggagaagtcgcccagagcatttgagccagaaaggcctcaatcaccaggaaggaaagctgagccttggtgggaaggagtgcaggacgaatgtgaccagaggtgcccctgggaagatattctgagcgcctggaacagaggctggcttggctgatgggcaggactgggtcagggaatgtgtgacaagccatcagggtgagagaccaggtggctggattagaagtgtcacctggtcatctgggcatggtggctcacgcttgtaatcccagcactttgaggggctgaggcaggcggaggatctcttgaggccaggggttcaagacaagcctggccaacatggtgaaactctgtctttattaaaaatacaaaaattaac

SEQ ID NO: 101536 - DNA, 403 bp, Homo sapiens
ggcagccgagttcaatgagggatgagttggtcatcacgggagagggagagacatgcgaggcatcacctacccacttgcctgctgcttttcctagcagggactgtgcctgaaaaagcctcccctgccaagcttcagatcaccacggttgcaccggaagctgagagcttgcccaacgcctcccactactcaagggtcagtcactcactatagtgactgagtgcatggcctggacagcaacctgctcagttttccaacaacctgtgatggttgcaatggtcacattcatcttacagctgagaaaagtggggcttcagaagggaggggacttgtccagggtcacatggctaaaaagcagcttctcgggggcctccaactgcatggccctctaaggcccactcctttc

SEQ ID NO: 101537 - DNA, 602 bp, Homo sapiens
ggggaaaaatctcaccaaaatctcttggatgcagcaaaagcagtgttaagaggaaagtttgtagtcctaactgcctttgtcaagacagaaagatctcaaattagcaatgtaactttgtacctaaaggaactagaaaaaaagagcaaataaactccaaagctagcagaagaaaataaataactaaaattagaaaagaacttaatgaaattgagacgtaaaaatctataaaaagatcaacgtaaccaagaattggtttttcaaataaataaataagattgatatgcctcctagctatatgaacaaagagaaagaaagagaagacccaagtaaagcccgatcagaaatgacaaaggtgatattataactgaccccacaaatacatcctcagaacccaaatatactcagagatgactgtggacaactatgcacataaattagaatatctagaggaaatgggtaaattcctggaagcacacaatctcccaagattgaatgaggaagagattgaaaccctgaatagaccagtatcaacttctgaaactgaatcagtaataaagaacctgctaaccataacgaaagccctggttcaggtgaatttacag

SEQ ID NO: 101538 - DNA, 908 bp, Homo sapiens
  misc_feature (287)..(287): n is a, c, g, or t
  misc_feature (366)..(366): n is a, c, g, or t
  misc_feature (441)..(441): n is a, c, g, or t
  misc_feature (474)..(474): n is a, c, g, or t
agtcgctgtggcactcagtcctacggcctccgaggctgggtagtcagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacttacaatttcatcagaaattcctanaagaattcgaagtgccttaaaaaatgcagaagaatcaaagcaatttcttaatcagtttctggagcaggaaactcatctnttcagcgccattaacagccatttgctgactgcgcaaccttggatggacgatcttggaaccatgattagccagatngaagagatcgaacgtcatcttgcttaccttaantggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcgtcagagatgaattacttactgagccaaagcaactcccagaaaaatactctcttcctgcctccccttctgtcatcctgcccatc

SEQ ID NO: 101539 - DNA, 1045 bp, Homo sapiens
  misc_feature (424)..(424): n is a, c, g, or t
  misc_feature (503)..(503): n is a, c, g, or t
  misc_feature (578)..(578): n is a, c, g, or t
  misc_feature (611)..(611): n is a, c, g, or t
agtcgctgtggcactcagtcctacggcctccgaggctgggtagtcagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacagataatggtgatctcccttcttatgtgtctgcattcatagaaaaggaagtcggaaatgaccttaaatctttaaagaaacttgataaactcatagaacagaggacagtaagtaaaatgcagttagaagaacaggtacttacaatttcatcagaaattcctanaagaattcgaagtgccttaaaaaatgcagaagaatcaaagcaatttcttaatcagtttctggagcaggaaactcatctnttcagcgccattaacagccatttgctgactgcgcaaccttggatggacgatcttggaaccatgattagccagatngaagagatcgaacgtcatcttgcttaccttaantggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcgtcagagatgaattacttactgagccaaagcaactcccagaaaaatactctcttcctgcctccccttctgtcatcctgcccatc

SEQ ID NO: 101540 - DNA, 546 bp, Homo sapiens
aaaagggaggtgccacacacttttaaacgaccagatctcaactcactatcccaagaatagcaccaaggtgatggtgctaaaccattcaagagaaactgcccccatgatccaatcgcctcctaccaggtcctacctccaacattgggaattataattctacatgagacttggtggggacacagatccaaaccacgtcacactctgacccagaaggctcagtgtgtttcagctttggattcccaagtagagatccagtgttttcacttccagaatgcttttatacttgattacacactgtttccatgcctttgcttgacttcctatcataacgatagccctttatctggtattcacgtatcaagcttcccctttgctttgccagtacatttgcagcgtcttcaatccctgagtggagagagaaaggtttgaaagtggagactgcggtgatgatgaagatgagtgcattggaggctctggtgatggaatgataaaagtgaagaatcagctccgcttccttgcagaactggcctatgatctggatgtgga

SEQ ID NO: 101541 - DNA, 433 bp, Homo sapiens
agggagctcagtggcctctcaattcccaaagcacattctgtcacttctactcaactggcccttctcttattaatgcctggtattgttaggtatgtctttatatatatttgtcatctgccctcaagtagttttgaggacaaaaacaaatgggtttaaaacttccttacaccattccctccatgacaccaagcacagtgctatcacacagtggatgcttaataaattcattaatttagtctgcgtaaattcattgagtggctacaatctgacaaaaattctgtaaggcaggccaggtgcagtggctcccgcttgtaatcccagcactttgtgaggccgaggcaggcagatcacctgaggtcagaagtttgagaccagcctggccaacatggtgaaactccatctctactaaaaatacaaaaattagccgggtgtt

SEQ ID NO: 101542 - DNA, 1428 bp, Homo sapiens
atttaaaacactctatcctgaaagagtccactgcttccaagtgagaaaagccaaggagtcccctgcgttgggggtgtaataacctagactagagcttatagactgaagcccatgtgcttctccatgctcaaacgcagaactaaaaatgggtataaagtcagaaaattgcagaatataagtctgtgtttcaaaaagcaatcaggaaaaaacaaacaaaaaacttgttttagaatacaaatgcaagaaaagttcaatttcaacagcagaaagatggcctggggcagtgagatgctttccttagctgtacttgaagttttatggaacgccatttaaattcagacatcaagggaatgaatgcagttttaaaaatccgaattatttctggagtctacaatgtcagtgttagaactaatgctgggttgttttgttttttcatttgcttgcactggaaggccttgaaaacacacaggagtgtagagtatcgtcagctctgatgctcagtttcttcctggcaatagaatggttttatctgtgccccaagcttttgccaatttaaactctaaactaaattttcaatgacaccagcatgtttgctttaaatttagcaatagaataggcaatggactgctttgcatttccttagtttttcattctgaaacagagcaaaacatcttcccaaagagatggagacaatctcttctgggtagattccaagtataacctgtcccagggtcctcttgctcagctgtgactaacaaaagtctgttcaatttaactacttagataagaagcgcaatgcttttatttaaaaatttaatattttctatggggctgtattttccaaataatagcaacaaaactgtcctaacgttttcactgttctgtaattttgttttaatatagaggatacccataatttcttaacactggaaacatcattctgaacgatgtaggaagcggtcagtaacgtgaatgatgttattgtaccgtctccagctttttccttcttcccccagatggtcgcacctgtgcatacatccctgtgcatgtgggggcacatgagtgggaaagtgggtgtcactcctattttctgtcctagagtgtcagcgttggaagggatttttttttgttcctccagtccggccctctagttgatagtccagtagtctgttaacaatttgtaaggacctgggttatattttaaaggtggttgttgttgttgtttgggttcacttatgtatatgcagcttgactgttcaacccagatttttaaacaataaaaagatttaatgtcaccacaacaccaaaacaaccaaaacaaaacaacaaagagaaaaagacaagaggagggcgacacacaacgcaaccagacagaagagacgaagaccaaacagacacaaaagaacaaacgagaacgcaaaagaggaa

SEQ ID NO: 101543 - DNA, 442 bp, Homo sapiens
ggctgctgatgggcgaggagaccctgtgcccttctccctgggccccggaggatgagggcagaaagtgagggttgttgggtgatgggggcaaactgatgtgctgtgggcttttcacagcccccagcggtgaatgctgaggggaacactgggggctgagaaatgtggaagaaagtacattggtttgatctgaggactccacacaatgagcatttccaagaggctggagttgagcagcttcacaagccggtgggtgacactctgagctgctgctttgtcttttcacaggtacttgggatgcaaaaggacagctggagacagcctcttcctgcttgatggaggcagccaggaaaggcagcggcttcttctctgaacagttattccttttctgcttctgaagctgcatcctcagctcctccacctgcctctgctcttgctggagttt

SEQ ID NO: 101544 - DNA, 498 bp, Homo sapiens
gcggaacttgcaatgagccgagatcgagccactgcactccagcctgggcgacagagcgagactccgtctcaaaaaaaaacaaagaaaacatgtaactatgggaaaataatagtggcattatgggctgggcgcagtggctcacgcctgtaatcccagcactgtgggaggctgaggcgggtggatcactggaggttaggagtttgagaccagcttggccaacatgataaaaccccatctctactaaaaatataaaaaattagctgtgcgtggtggcgggtgcctgtaattctagctactcaggaggctgaggcaggagaatcacttgaacctggaaggcggaggttgcaatgagctaatatcgagccactgcactccagcctgggcaaaagagtgagaccttgtcttaaaaagaatggtggcattataaggttcctgggtgcctaggggcccgaggagggaggaggggctgcccccagctggaaggaggagcagggaagg

SEQ ID NO: 101545 - DNA, 255 bp, Homo sapiens
gtttcactctttcacccacgctagagtgaagtgttatgatctcggctcactgaaacctctgcccccccaagttcaagcaatcctcctgcctcaacctccccttatcagaaaaaaaaattgatgaactatttcataagccacccctgttgaagagtcattagaaggattcctgaacactgactaccaatttacttaaaatacttaaaaagatgtaacgcggccgggcactcatgcctgtaatcccagcattttggg

SEQ ID NO: 101546 - DNA, 209 bp, Homo sapiens
aaagtatgcagcctgtttgggtatggtgacagaatcgaggcagggacggcctgacatgtgtttattggtgagcagtcttgtgtctcttccattgacatgtaactctcatgagagcaaggactattacctctttagttcatttgtcttacccagcacttagaagagcgactggcctggcacacggtaggttctttttttttttttttttt

SEQ ID NO: 101547 - DNA, 432 bp, Homo sapiens
tgagacaggttttgttgtgtcagccaggctggagtgcagaggtgcaatctcggctcactgaaatctctgcctcttaggttcacgcgacttgtgcctcagcctccagagcagctgggattccaggcgcccaccaccacaccaaaccactttttgtatttttagtagacatggggtttcaccatgttggccagactggcctcaaactcccgacctcaagtgatccgtctgtctcggtctcccaaagtgctgggattacaggcatgagccactgcacctggccaactttttattcttcttctagttctcaggttgtcctaggcagatttttagtgccgttacaaaaaccatcctttccccttctccatgttccatttatcttcctggtttagaaaaaagtgtcttccccttgtttctccaccgcaaaatgtacac

SEQ ID NO: 101548 - DNA, 811 bp, Homo sapiens
agccggattgaaagagagccaggcccttgagggggagggggctgccaagatggcgtcggcctcctccgggccgttgtcttcggtcggtttttctccgttgatcccgcggtcccttcctgtacctcgtcctcagcatctggaatcaagagtcccatggcatctgaggtgccttatgcctctggcatgcccatcaagaaaataggccatagaagtgttgattcctcaggagggacaacctcatcagccttgaaaggtgccatccagttaggcattacccacactgtggggagcctgagtaccaaaccagagagtgatgtcctcatgcaagatttccacatggtggagagtatcttctttcccagtgaagggagcaacctgacccctgctcatcactacaatgcctttcgtttcaagacctatgcacctgttgccttccgctacttctgggagctatttggtatccggcccgatgattacttgtattccctctgcagtgagccgctgattgaactctgtagctctggagctagtggttccctgttctatgtgtccagcgacgatgagttcattgttaagacagtccgacataaagaagcggagtttctgcagaagctgcttccaggatactacataaacctcaaccagaaccctcggactttgctgcctaaattctatggactgtactgtgtgcagacaggtggcaagaacattcggattgtggtgatgaacaatcttttaccaagatcggtaaaaatgcatatcaaatatgacctcaaaggctcaacctacaggcggcgggcttcccagaaag

SEQ ID NO: 101549 - DNA, 490 bp, Homo sapiens
tcacatttttttttaattctaaggctttgaaacccaatttgtattttacatttaaagcatgtctcaattcagactagtacatttcagctccatggctggtggctactatattagaaagcagatttgtctaaagcaaaggcatagctcaaatcatttctctgggaacctcccaatttattcctcataattctcctcatattagtaacaattcaaaattagtaataatgtggcaaaacatttgtacttcaaaaaatattgcaccataatggttaaagaaattggttctgtggtgtcaaactttagagtctgaatcttgaatcagcatctaactttacagacctggattcacttagcctcagtattctcaaatagtggagttatctacttcactgtggttgaaaggattaaatgggaaattcgagtaaggcacctacaaagtctggtaagtagtctgggtactcaatgaaaattagttacagttgctagaggt

SEQ ID NO: 101550 - DNA, 446 bp, Homo sapiens
gtcgactactaatatgaggagaattcagactagtacatttcagctccatggctggtggctactatattagaaagcagatttgtctaaagcaaaggcatagctcaaatcatttctctgggaacctcccaatttattcctcataattctcctcatattagtaacaattcaaaattagtaataatgtggcaaaacatttgtacttcaaaaaatattgcaccataatggttaaagaaattggttctgtggtgtcaaactttagagtctgaatcttgaatcagcatctaactttacagacctggattcacttagcctcagtattctcaaatagtggagttatctacttcactgtggttgaaaggattaaatgggaaattcgagtaaggcacctacaaagtctggtaagtagtctgggtactcaatgaaaattagttacagttgctagaggt

SEQ ID NO: 101551 - DNA, 555 bp, Homo sapiens
cagagtctagcatacagaagatgtaaagccacattctgtgaaggtaagtagatgtgtttacctcttttgcactgtactggtgcattatggggtaaatgtgtattacttttccttgtattgcttagcacagagttttgcctatagcaggcaccagactgtgggcttggtagtacatgactattggtgattacagatcaaaaaggacttgaaatgatcagtttaaggtcttgatgggtattgaagactcaaaggatgatggcaccctgggagtgatccacagaaggacagattatttgaagatgttaataactaaagacaacatggatgttaaatgatgaaaaaaagttggatggaaaataaaccattggatctgcctctggagtccaagaagaatattattcttcctacctcccccttactctggctcttcctattgtagccacatgggtcagtaatgccattgaaaaacacaattttagactaagtggggtcgcagaaattttggtctatcttaaattgatgacatcttattaaagaatttattgtataaaaaaa

SEQ ID NO: 101552 - DNA, 297 bp, Homo sapiens
ggcagaggtaacagcagagatgagacagcatgatgccttcagggaccatgtagcttgtaaatggattttaatcttttgtcgtaaagacaataaagagcccctggaaggttttatttggtttaaagatctatctacctttattgtttttttttttctctgatgacaaatcatatatgctcattataaaaagcaatgaacacattacaaatatatatatttatctagatacatatgtgtgtgggtatgtgtgtgtatatatataagtgtatatatataaagtaaagcatatatatctat

SEQ ID NO: 101553 - DNA, 151 bp, Homo sapiens
tcatttaattttttcgccacttggttctgtgatgctgtggcttagtaggcctgtctctgttctcagcccctttgcacacttcctagtctttgaggcttttcccaaagttcaacccttaagccactctctgtagcttttcagactgttttac

SEQ ID NO: 101554 - DNA, 1057 bp, Homo sapiens
aattacttctgcactaacctaatatatctcttgtcacagactaaggttctccttgccactgactaatgtaagaattggaaactcacatgtcgtgctcatagatttacttaattcaacaaacttctttttgttttactacagtatggcactgctataggaataaggaaataaaaacaaataattcctagttcaagctcttgagaaactagtgtgatgcaacctcaaggaatgcagcaagtcatacctgtcattaatgtcagtgaataatatgtgtatagatctctatctcaaagttctaaataaaaattaagtgctactcatttattcataaggtacacacacatgcatgctcatgtgccacatacatacatacacacacacacacacagtggacaaaatttgagaaaaaaagaaattcatactctgataaagggtgttcatagggacctattttaaatttggtaatcagggaaaagaaatccctaatgaggtgacacatatctgaaacaaaaagggtaagtatggattaggcaagtgaaaagctggagataagagtatgctaggtaatgtttaaaagcttagagacagaaaagggcaatgtatgttcaaagaccacgaggtaaaagtgatgtgagctgaggctggaaatgaaggcagggtcagacctcagagggcatgtcctcttcttgcaggtttgcattgcctggacacatgctttccgccacacgtatatatggacgatccttaaaatttgttaacaaatgactggagttagcctgtttgctttgagttatttgatgagcatgtttgatattgttccctgtcttccttatttccctcttagatctgagacttgttattagagaaataggatagtaaattaagtttcgagtactctattatgttacagatatttgcttgtccaatgagaaatccttaaaatatggccttttctgtatttatagattgtctttcattaacaataaggcacaaaggcatcgcagaaacgatgggaaaatgtgatgaagagcatcccaagagctgaaaatgcattggc

SEQ ID NO: 101555 - DNA, 975 bp, Homo sapiens
atagaaagataagatggttttggtgtcaagttcaccaaaccctcaacaggtgcaatttgtttccacagagcaaaaaaagaaaacattgctagtatagccttgataccgaaaataggtgtatacaagaaattatataggcaaattttactcatgatcatagatacaaaaaatcctaaacaaaattgttggccaggcgcagtggctcacgcctgtaatcccagcactttgggaggccaaggcaggcgaatcacttgatgttaggagtttgagaccagcctggccaacatggtgaaaccccgactctactaataatacaaaaaatagctgggcatggtgggcacacacctgtaatcccagctacttgggaggctgagacaggagaatcgctggaacccaggaggtggaggttgcagtgagccaagattgtaccactgcactccagcctggctgacagagcgagactccatctcaaacaaaaaaaaagttagcaaacaaatcctacctatgtattaaaaaaattatgacttagaagacaacagaagagaaaatagacaaattggattcaataaaatttcagaactattgtacatcaaaggacactatcaacagagtaaaaaggcaaccaacagaatgggggaggacatttggaaatcacatatctgataagggactaatatctaatatatataaaaactaaaacacaacaacaaaaaacaacctattggatttgaatagacatttcttcaaagatatacaaacttaaatgttcattgatggataaagaaaatatgtatacatacaatgagatgttactcaaccttaaaaaggaataaaattttgatacatgctataacatggatgaaccttgcgattattatgctaactaagccagacacaaaggacaaatatcctatgattccatttctgtgaggtacctggaacagtcaaattcatagagatagaaagtaaaagtag

SEQ ID NO: 101556 - DNA, 691 bp, Homo sapiens
ctccaccggggccctgaggtctctcctgcatggtggtgtcatggccagagcagcccacaaaagagatcttagcccagaacgtggggctctaaggagaaatgtccctaccaatgccagttacctggactctcagaattcagatgtttttggcatgaggaagaaagcactttgaggctttaactggaagacccattggggcacagaaatggttacaagggctggacatagtagctcacatgtgtaatcccaatattttgggaggctgtggcgggaggatcactggaagctaggagttaaagaccagcctggggaacatagtgagaccctgtctcttaaaaaaaaaaaacaaaagaaagaaaagaaatgtcacaaggagccgtaagagtagagctcttttcagtgccctggactcagctctaccactgatttctttgtggttctcagatcagcttctgccgctgtatttcaggcatatcgtcctgatgagagccctttgactttgacatgctgggagtttaaacacaaaatccaaagatcaacaaagccaggagggctgggcactgtggctcaagcttgcaatcccagcacttgggaggctgaggagggtggatcacctgaggtcaggagttcaagacccacatggccaacatggtgaaatcccatctctactaaaaatacaaaaaattagctg

SEQ ID NO: 101557 - DNA, 338 bp, Homo sapiens
agatccagtttcatctttttgcatatccagttgttccactgccatctgttgaaaagactattctttcccccatgtaatggttttttggcaaccttgttgaaaatcacttgatgtgtatgggtttatttctgaactctcaattccattatttggatctataggtcttttcttgcaccagtattacactgtgttgatcatcatggcttccttagtatgtttttgaaatcaggacacatgtgagtcctactttattgtttaggcttttctgggtcttttgcaattttttatgaattttagaatttgcaaatgtctacaaagactgtgttaaatctctggat

SEQ ID NO: 101558 - DNA, 231 bp, Homo sapiens
ttcattccaggcagagtgctcgggagacctttacctgttttacctgattacatcctctgagtcacaacgagaaaggaagccgagcaacagccagacctgatcttctttaattgtgctctgtggaccaaaggcaacagaattacctaggccccacccagaaaatgcagaatcctgggtcccttatgaagccaccgaatcaaaattgtggggagcaaccaggaacctgatttt

SEQ ID NO: 101559 - DNA, 476 bp, Homo sapiens
ttcattccaggcagagtgctcgggagacctttacctgttttacctgattacatcctctgaggtatgtgccatttatacctggggaaactgaggctcagaaaaatgaccttgtctgtggtcacacagctggtaaggggtaggaatggaatttaaacccagttgtctaacttcagggcccacatttcagccacaactgaggtttttcctaacctaaccccattgtggtggaattgcacaaaaaacatacttgagaggtgagtaatgtcatcattccattacatacaagttaaaagactatgcagtatgataccttttttgctatgcacacacatatatgtgcataaatagataggtagataaagagacagacacagacataaacaggaaaaaactgaaaaggcataaatcaatgttaccaatattttaacagtgattaccactggatgatgaataaattttaatcttaaaattcctga

SEQ ID NO: 101560 - DNA, 398 bp, Homo sapiens
agggtgttccaggacaaaaaagcagcttgagggtgcaagggccagaggcatgccagagcactgggtggttggaagaatgaggattaggaattcactctgcccaaccggaaccctgagaagggatgggtctgagacctgggtctcaggtcacagccattctcactcctccagaccctgggcctctgtgcctcccattccaaggtgttgggtcctcccattcctgagcctctgtgctgcagactcagggcctctggctgaggtgccccctgtgaacctgggtcattgcatccccgctctcagatgtcagatgtctctgttcattgggtcctctatgccctgggtctggtcttgctgtgccccctaatcctgggttgctctgtcccccagatcctgggtct

SEQ ID NO: 101561 - DNA, 545 bp, Homo sapiens
acttgctagaggctacttggctctagtatgtttggctctaagatcaggatgggtaaaatcttgggacaagagaagcaatgtagcaagtgtgagtgaccatctttctttttttatgggtcatttcaactttttctatgggaaaattaaaaaaaaaaaaccaactttttctgttcccaggctgaccctcccccctccgctttttttcattttgtgtctcagtaaaattccactgctgttcagcataattacttcttggatcttcacttcctctctatggtaagcctaaatgctgaccatctcaagcagtaattcaacaaatatttattgaatggcttctatgtgtgaaacacttggcactggagatacaaagatgggtaagaaaatatgtgccctaaaggagctcatagtctttgagtacaaagatagggttcaacaactaaactataatcactaaactttagattagaaggttgagaagagctctgtagaatcaaagaagaggtattacttaacaaggcctgagaatatgagggaaagtttcatgg

SEQ ID NO: 101562 - DNA, 408 bp, Homo sapiens
tctgcctcccaggttcaagcaattctcctgcctcagcctcctgagcagctggaattacaggcattcgccaccatgcctggttaacttttatatttttactagagacggggtttcaccatgttggccaggctggtcttgaactcctgacctcaggtgattcacccacctcggcctcccagagtgctgggattagagctgtgagccacctcgcccagccctaatgcagttctctctatagtcccaccacatgggcagagctgggtcatcagtgtctgtttacagatgtggaaactgaggctggcccctaaaagaactgtgaggcccaagctgacggtgccacaggctggaaggtggctggtccccaaatgaggagcacagctcccccacccccacacgtcctggactaca

SEQ ID NO: 101563 - DNA, 303 bp, Homo sapiens
accaaaaagtacagctatgatttgtaatagagtaactgaaggcagcccctggaatgatctttaaaaataaatgagatcaagttctgctcttgctcaaaattgctcaatggctttccaaagttaagttcaatagaaagtctttcctatggcctgtaaggttggcctgattcctcttaggtgacccttctctcctctgactccaccatagatattttcccttttccccaagttaatttcctccttggggactaaatatttttcttggggccttttggactttgcctccagatgtaagcatggctg

SEQ ID NO: 101564 - DNA, 189 bp, Homo sapiens
gagatcatgccactacactccagcctgggtgaccaaaaaagaaggatttagtccttatctggatctggtatgaccaggtggcaagggtagggcagtaatatacacaatagccattctagggttgaatagaaaagaatatttagcaacactatggaacttcagcagcagagcccagccattgcactccgg

SEQ ID NO: 101565 - DNA, 287 bp, Homo sapiens
tttacttctactttgcttcccttaccaaaagatagaccaaaaagggtcaaaaggattaatggagatacaaacaagtggcctttaaaaatatgtttttttaggctgggtgcggtggctcacacctgcaatcccagcactttgggaggccaaggcagccagatcacttgagctcaggagttcaagtcctgcctgggctacaaagtgatacattaaggaaggttaaggttgggaattgatggttagatttagtaatgtggtgctcactaatggtcttatatcctgtatcc

SEQ ID NO: 101566 - DNA, 618 bp, Homo sapiens
ggggaactctgaccttgcggaggaaacttgtttccctttttttcttcccgccgactttcactcgataaaaccctgctttattcaccctttaaaccttctccaaacctaaattttcctggccttgggacggacaagaacccagtcttcagatgaaggaaggaaaagtcctgcaacattcttggcgtgcaacgttggggctcttgaagagctccagaattgggattctattttcaaggaatgtcctagacaacatggcattattaattgaaaaggaaatatattccagaaatctattctgttaccagctgtatcagaattccacagtgcatctggttcttgggcaagtcactgaaacgtgggtcaaatgttgaaagctactgtactgtgatgtgaaaataaaggacagttataacaaaatactgcaaactcagtggctgaaaacatcagaaatttatcatctcacatgtctggaagctagaaatttgaaatccaggtgctgtcaaatccatgcttcctctgaaacctgtaggggaacatccttccttgccagccgtctctggtgccctttgtctcataggtacatcattccaatcctccccttttgcattgtattctccc

SEQ ID NO: 101567 - DNA, 340 bp, Homo sapiens
  misc_feature (179)..(179): n is a, c, g, or t
  misc_feature (228)..(228): n is a, c, g, or t
taaattgagacaaggtctcactctgtcattcagcctggagttcaatggcacgatcttggctcactgcaacctacgtctcccaggttcaagcaattcttgtgcctcagcctcctgggtaactgggaataagaggcacgtgccaccatgcctggctaatttttgtatttttagtagagatngggggtttcaccatattggctaggctggtcttgaactcctggcttcatngtgatccacccacctcggcctgccaaagtgctgggattacaggcctgagtcactgctcccagcctaatttttttgtttgttttttcttgtatttttcgcagaaacagggttt

SEQ ID NO: 101568 - DNA, 323 bp, Homo sapiens
cctccctggggtggtttgtgagttggctgattttgttggggaagaaactgaaacccaaatgtcatggggtgacttgctctaggtcacaccaggtaaataccagattatgggcacagaacacattgtcccggccctggcattactctaatcgcggcctttgtcgtgaggcttctgtcattcattgattgctcattgtgacaccataagttcccatagggcagggactctgtgtttcctttgttcttcagaaggacttcagccagacctgccagacctgtctgtgcagctcatgccttgtcgaagaccaccacataatttaacca

SEQ ID NO: 101569 - DNA, 328 bp, Homo sapiens
aaaaatagatataaaagagcattgtaaagcattatattctatttaaaataggattctactcaattctatttaagaatattaaagcaatattatccagcattttaaaatatgaacactgcatgaggtaataaggacattattagctatggtagccatgggagggaagacactaaatatttttaagcgtaaatatacaccaaaggagaaggattaacatgcattttggcttcaatttacataagaaataaaagtcaaacatggcatagtagattttaattacaaggagagactagtttgatattgatatttgcaaactttatgccatcac

SEQ ID NO: 101570 - DNA, 714 bp, Homo sapiens
gcagagaccccaactggcaatgcttgtttcagactgtggtgccaatatgacctgacgtggaggatgtttaggcaactaagcatagtttggtcagcatccgaacatcctccacatcaggggatactggcacctcatttgtgttgctggaaaactaaagccagtcactgccccccaggtgcatccttgccctggggcttgacctcaaacccctggcaaacatcagcatgagggaacagcccctcctgaatggccagccacctgaccctcagccttgttctactctcatcctgccctggatggtcagggaactgcttcagtcactataaggtcagcagtggctgtgcccacggatggaggagcagaccctgcattggcctcatcctcctttatccccacactgtgttgctcccattccacctgccacttaatgaatagtaaacacatttgctcttccttatgattttcttagtaacattttcttttctctagctagcttactttattgtacaaaatatagtatgttatacatgtcacatgcaaaatatgtgttgatcaactgtggatgccatcagtaaggcttctggtcaatggtgatgcgattgcttagttacattttggaggagttaagttatatgcagatttttgactgtgcagggggtcgacgcccctaacccttgagtttttcaaggctcagctggaattgtcttgggtgct

SEQ ID NO: 101571 - DNA, 198 bp, Homo sapiens
ccaacagcctaggtgggcttcctgtggagaggagggaggagaagtcaatgacagggatttcatgaccctcacagaagctttctcagggagaagaggcctcatctaagatttttgtttgtcttttgagacagtgtctcactctgtctcccaggctggagtgcagtggtataatcttggctcacttcaacctctgccttg

SEQ ID NO: 101572 - DNA, 146 bp, Homo sapiens
ttctacccagccacttaaaaacctgttgtagcttaactttctaatgatgttaatgacttgatcaacatttgcacttgaataacatatgcattgtagcataccatacctaacaataaagtaagccataatattatttatgaatcaat

SEQ ID NO: 101573 - DNA, 807 bp, Homo sapiens
aaatgttaattagtaatgatgagatggggcttccttgttttgttcctaactctgctaagaataattttaagaatgatgttagcttggctgttggtttaacctaggtaatatttatcttgtagaagaaatattctattatgagttttatgaagcctctttttttcctcccctttctctaagttaggaattttaaattaaggttattgaaacagatatgatcttccttattgcacctcttgatgaactagatgatgttatcaaatcttctgatcttaaaccatccttgcattttggagataaacaatattgccagtgcagtgttttatttgggacatttgaatctaacatcacatattagcttggcctgtggcttttgttcagtgcagtatctttgtcaagttcttttttttttttttttttttttgagacagagttttgctctgttgccaggctggagtgtgcaatggcgcaacctcggttcactgcaacctctgcctcccaggttcaagcgattctcctggctcagcctcccaagtagctgggattacaggcgtgtgccaccatgtctggctaatttttgtattgttagtagagacagtgtttcaccatgttgaccagaatgttctcaatctcttgaccttgtgatccgccccccacctcagcctcccaaagtactgggattacaggcatgagccaccatgctcaacctctttgtcaagttctttaagggtgttatgttcatttcataaaatgaactgggataacttttatagatttctgtgccctaaaatagtttttctattatag

SEQ ID NO: 101574 - DNA, 917 bp, Homo sapiens
cctggtgccccccaggggtgacacatatggtagacagggtcagctttctcaaatgctgtatacagcatggctgggcacattcatgtaggctaagccactcctttacctggccctaatgccctgtgatgaaaaagcctgtgccaggagagtgaacccaaatttcagaccactggtctaggacttaagtccaatagttaatttcaggtccaagagttaggacccaaaagggactgaccctggccaaagccactgtatggcacacctctgggaacccccattcatatggaatacaatgctagtaatgccccctggggatgtgcagctgctgctgaggcaaagaatgtgaggaacaaccattgcttgaggaccatgcattatgtttgtacatcacatgtgatttcttttactcctggccacaacataaggacatattattagaccagtttcatagatgaaggtagtaataagtggggccagaatttgagtatctctttcctgctccaaaactgttggtcaagcttcttcctctataaaatgagatcagtagctcagtgatctccaaggtccctttcagctgaggttctgaggctgcactgttcagtatggtggccgtaagctacaagtgactattttaatttaaattaaataaaactaaaaatctagttctttggtcacactggccacatttcaagtgctcagtagcaccagtgcctagtggtgactatgttggatggtgcagatgtagaacatttccatcatccatcaagttgtatttgcacagcactggtctagggatttagataaagaagaagacatgaacaaacagcataaaagcagaaatacaaggccaggtatggtggctcatgcctgtaatcctagcactttgggaggctgaggtgggaggatcatttgaggct

SEQ ID NO: 101575 - DNA, 311 bp, Homo sapiens
gaggcctgtgagcaaaagagtgatatgatctgaataaaattttaaacagagagctgcaattgatttatagagaacagaccatgtagagagcatataaggtggctgtgagagtccctaggcaggctactgccatgacatagtgacgatgatgtgacttggaccagagtgaggattaacggaagtggtaagcaattattggattccagattggggagaaagaacttgattactcaaggttttggcctgaaagtatggaggaatggagttactattttttgagatggaaaagagagtttgagttgcaggttggg

SEQ ID NO: 101576 - DNA, 223 bp, Homo sapiens
ttgaggttaataaatcagctagtatttttttaataatgatatgccttatgtttaaaagctaagaaaaaagggactattatataattccatttgcaaggacttttccatagtgacatacatcccagaaataccttcacctactccaggggttttaaactgccaaataggtcctactgactggccagcatagcacgaaggtctaccttaaacattctgccccctc

SEQ ID NO: 101577 - DNA, 825 bp, Homo sapiens
ggggctccttgtggctgaccctccatgctgtggcagagttcttgggacaccaggcagggaaagggctgggggctccacccatgagccacagacctagggaggtcccagcatggttgccggggcttctctgcctcttggctccggcaggctgggtcaatggcatcacgaacaatgtctccagcctctgtcttctcccagtgccttagtggatgaggttgccggagtaatgaataaaacactaattattttatctcatatatataattttgagatggagtctcactctgtcgcccaggctggagtgcagtggtgtgatctcaactcctgcaacctccgcctcccgggttcaagcgattctcctgagtagctgggattacaggcacccaccaccatgccctgctaatttttgtatttttagtaaagacgggtttcagcatgttggccactctggtcttgaaactcctgacctcaggtgatctgccctccttggcctcccaaagtgctgggattataggtgtgagacaccgtgcccggctatgaataaaacactattttaaagcatgattgagttcatggcagctctttgtaattaaatattttcttaattgatggatactaaaaatacaaccagtatcatgtgtatgggggacagtccacaaacttttggacttgaaaaggggtcttcatatcccacaaacaagtggggaagaggatctttgtgttggcataaatcgggttatggcttgtaagtaagacagtgctctagatggccagcaacatccccgtggtcagtccagagtgatgtcagagcacgtgtgtgtgaga

SEQ ID NO: 101578 - DNA, 216 bp, Homo sapiens
tggtggttgccaggaggtgggggagggagaaatcaggagtgagcactcgtgggcatggggtttcttttgtgagtaacgaaaatattctggaactagacagcagtgatggttgcacaattctgaatatactaaaaacaactgaactgtatgctttttttttttttaagatagagtctcactctgtcgtccaggctggagtgcagtggcatgatctct

SEQ ID NO: 101579 - DNA, 625 bp, Homo sapiens
tgataataaaaatcatagcaatacagagcggtaacaaggggttagcttgtgcagactgattttctacatcagattaatttaaaatgaggaaataattttcttcttaataaatgtaactttcattaatggcacctatgtttccaaacatgagtgccactggggaaggcaatacgagctgggtgaccttcctggagagagaccagaaccatgctggggagaagtcccctgcagaccaggctgttccagggacagttctctggttgcactggcaatgaggcatcaggcagccactgcacttcctctgcacccctctttcctcatgtaggaaatgaaagaacaggaatagcactctcttggttctcttttcgctctcctctttaggattctaactcgtaaacagagaacagtgtgcgttgaagcttaccctgccaaatcgcctccattattctcaaaaagaccatgggacacaacacaagaagaatatttacaattggttttgaaccttaacttcaatatttcctaccttgtatgtggcagaaaatttatcttactttctggaaaacatgtttcgttctactgtaatctttattatttaaaactatttatgtaatcttattttcagggg

SEQ ID NO: 101580 - DNA, 220 bp, Homo sapiens
aattgcagcactttgggaagctgaggtgaaaggatcacttaagcgcaggagtgacagatcagcctgggcaacatgacaaggccctgtctgtacaaaaaaatttaaaaagtagctgggcatggcagggcacgcctgtagtcgaagctactcaggaggctgaggtgggaggattgtttgagtctgggaagtggaggttgcagtgagctgagcttgcgccact

SEQ ID NO: 101581 - DNA, 542 bp, Homo sapiens
aaaaacgatgtatatgtgtgaaagcagttttaaaattctaaaatactaaacatgtatttttaaatatactataaaacagcttttcatcagttgtatttattttttaatatatcctcaactatcactcctgctttccaatatgccttagaactagttttcctaataggcatatgttcttttcttcataaataactgtttagtccttttcttcagattcaaactatactgctataaactcctagaaagcatatgtctgggaggaagttaaatttatttttgatctcttatttttaaacaaatttactttaattagagctcattaagtcggattttatatactaacactaccaattgaaaaataataaaaaatgaatgtgaagtaggcctaaataagtcaacgagattcaaaactacaattgaaccagatttttctgaaatttctccaatgtgttcagttatacaaaactggttttgggtaatatgacacctgtcattgaagttaccccttcatccagtgcaaatttaggaggaattttaattaa

SEQ ID NO: 101582 - DNA, 215 bp, Homo sapiens
cctggatcacgttttcttcatgtgttaaatacaatttattctctcaggacaggataactttgggaatttaatgcaaaagcaagtaaagttcaaatattagtttctcttccagataaggatcaagtgcaaattctatcatttagaaacaacatgatgcaggtaaatgcatgacaccccgacatttgaggcgcctgatttcagactcttctctgtgc

SEQ ID NO: 101583 - DNA, 789 bp, Homo sapiens
tcatgcttcagtgtatgttattaaaaaataagaattattttttaaaaagcataatcacaataccattactgcactagaacaaaacaagacaaatgacattaaattgccaaatatacagtcactattacaatatttctgacagactcaaatgctttttcagagttggtttatttaaatcaggatccaaaaagctcagctggattcagttcaggtctcttaatttatgtcttttcatttatttgttgaagaaactggagtctgtgtcctgaagaatttcccagatttttgaattttgctgattgaatccttgtgtttttttaagcatgtttttctctactgtatgtttcctgtaaacttttagttaaatctcaaagtgtgataagattcaaatatatataaagtatgaaaaggttcaaatatgtatatttatatatatatttaaaagttggtcttcagtgactgcatactttctgttttgttgtattgtaagctttacgtctactctcattgttattcacttacctcactttacaatattataaatagctttatttgtttggaatgcttgctatgtgccaagagatgtcctaaccattttgcattaaaaaatgaaaaggaaacaaaaaattaacaaaaaggaaaccttatctatgcatgtttttgctcacaattttgagtttgaaaaaatggtaaactcagttttaatttaatgacaataaagaatatcaatagtagaaaacacttaagctataacaatgttagttatgagatatgtgtgtgttcacccac

SEQ ID NO: 101584 - DNA, 337 bp, Homo sapiens
atctcttttcccacttcataaaagcaaaatatgtaagactagcatctggtttttgtcccaataaaaaaatcccacaactttcaagatatcactctagctttctaaagtagaaaggcaattcaggcaacaaaaaatattttttaaaaatctatagcccaaatcaccaaaaggtaaggaaagaactttcctagcaagctctggagaagacctaatttggacatcaaaatggagctttcagacactaatcaaggccattaattaaaaaaattttttcagaaaaataaggcaggttggatctcttttcccacttccataaaagcaagatatgtaagactag

SEQ ID NO: 101585 - DNA, 737 bp, Homo sapiens
tcagactttacccaagagaaagcgattggagaattgcctaatcctggtatcatgtttccggctatgacaggaagagatagatcataatagataaaaatggaaaatgttgtgaaaaaatcaaatacttctaagaaagacaaaacgcaagactcagctgtggtgagtgttaaaggaaatgagtgtcgcaactagatgaagctcaagacatatatttaaacatgttctaatggtggaacagtgagaagaacagctaagaataatggcctaagacagtctcagaaacccagggctcagcccctgactctttaccctcagtgattctccccatcaaaccccatgatctgtctgggcagtcttattctcaacacctcccttgatggaagtctaatctcagcttctagatattctaaccagaggtctaagtcaatcctttctgaaatttaaattcaattctttttttaacctgactctcaagagaaaaattcaggtactttctatttccaattcccttctctaaactgaaacataatgtaacttacttactcttctccccatgaaatagcttacaactttttgacctctaccaatggaataactctcacacacatactcctatgatcaggcctctgataaatattcaattatgttttccacttcttcccagggagttgcctgcaacagaaactgcaaatggcatacgaaagtttcctaattaaaaaataaaccatatgagtgat

SEQ ID NO: 101586 - DNA, 420 bp, Homo sapiens
tctggagggggcccagggtgctgcatgtctaagaaggatgctggaggctgcatttctaagtgatgccaacgatgctggccagtggcccacattttgagcacccaaggcaaagaggacacattacaccggacagcaatagtcaaggtcaacctgatccacgactttccccaggaaagccagttcttgtagcagaaagagttcagctagccttgggccacactccaacacttcaagcagcagcacgtactgtgcccaagcatttaataatgcacaagacctttacgcctgaagcatgatgaagagaggcaaaaaaagcagataacaacatcaccactgtttattgggctcgctgactttatgccaggcactgtgctaagaacattaagtgcatttttcagtgtatcctcccagcctgcagta

SEQ ID NO: 101587 - DNA, 339 bp, Homo sapiens
tagtaaaattcaaggtgagatttgcgtggagacatagaacaaaaccgtatcgggctcctcatcaccagtgatcttctcagctgctctcaaaccctccagtctttagaccttgtctacttacagctcagatcagcaagtcagaaatttgaggccaggtacagtggttcacacctgtaatcccaacactttgggagactgaggcgggaagatcacttgaggccaggagttagagaccagcccgggcaacatagtgagactctgccgctacaaaaaatttttaaaaattaaccatgcccagccctcattttcaacagttttagaaataattactatctgaaa

SEQ ID NO: 101588 - DNA, 269 bp, Homo sapiens
aattttagagtgaggaagtccagcgaagggggtgttggtattgtcactccatctctcacctcccctttcagccactcatcttcttccataaagaactttgtcatggacagaaagttttgtttcttgaaacctgtgtcttatgagatttcaagcaaatttcactttgcttttaaaattgtgccacacctcttgtaattctccttgagaaacaataagaggaagagccagcactcctctcagggaataaggcaggctcaggagcccaaatg

SEQ ID NO: 101589 - DNA, 437 bp, Homo sapiens
aaaatatttattatctggccctttccagaaaaagtttgccagcccctgccataaaccacagcagacaagagattaagctgtaggtactgaaatcagaccaacctgggttcaaaacctgtctttgccactaactgcttatatagcttgtcgaaagtcatctaatggttctaaaactaaaacttctaattttttttaaagaaagataggccaggtatggtggcttatacctgtaattacagcactttgggactacaggtgtgcgtcaccatgcccggctaatttttgtattttcagtagagacgggggtttcaccatgttgcccaggatgttctctaactcctgggttcaagtgatctgcctgcctcggcttcccaaagtgtcggcattacaggtgtgagccatcgcacctggctagacctcacgttctaatgacagga

SEQ ID NO: 101590 - DNA, 962 bp, Homo sapiens
tttgatcttcctggaattactgtaaatttctgatttgctgatagcaccttttcttatttgtcggagccgccatgaattcgtttatataaacttttaattttactccttttagctactgttgttacctgttttacttttatatctattttaagccctaccatacaccgttattattcatgctttaaacaattgtcagttgtcttttttttttttagacggagcaagactcccgtctcgggggcttaaaaaaaaaaaaaaggcggtttttaaaggaatcggggtaatggggcccagaagtgtgggtttggcctcagtataagtagacagaagggtcttgggtccagaacgataagggtgcataacgggcaaagtgcctaagtatctctataaaacgctattattcgtgatggtggattcacattttcacaaggtgacctggaatactcacccgtgagaacaacccgtggtttacaaaacactacagtataacatgagtgccagcagagggaacagataacaaataataaggggaaagcaggtgtcttaaacagccataagatataaagatgcagttaggatcagaggggaaaaccctcacagcgagtacgggacaacatatacgggctgctagcacactccaggcgtggaaattagagagccaaatacagacaatacaatctattgaggtgtacccactagaggcataatatttacaacacaaactaagggaacgttgaagaaaaccccccagacggaggatatagcagcttcaacaaaacaattgcacgccgttttatgtactaacaacccgcgggggctaaaagcgtggcgagacaacaaaggggcttcacccagaaaccgaaagtgggacactcgtggaaaaacccccgaaatgtgggaagaaccccgattccccccaggaggagaagacacgcctatagcgttattaaggacctgtagaa

SEQ ID NO: 101591 - DNA, 310 bp, Homo sapiens
ctagttggcaggattgtaagtagaccgaattctaatttttcccaacacatagtggtaattggaggttactgttatgaatactccatctgactacgactaagagagtgaggggtggttttaatgaaccctctaagctctctcagttccttcccttccacaaaatgcaagagcaaaagcaaactacaaacaggccttgtgctcaaccactggaaatgcctcctgggataagaatggcagcacttgaaaattctgccctctactgatgagacttcctgctgcctttggacataactaagccaggaaactttaa

SEQ ID NO: 101592 - DNA, 144 bp, Homo sapiens
acttatgaaatgtgcacgtgcgtgtgtgtgtgtatgcatgtttggccaggttaaaaaacaaaccaactgttcttgcaagggtacgatcccaagctttgccatgcacatagccaaatatcctcatattcaggacacataaatttg

SEQ ID NO: 101593 - DNA, 315 bp, Homo sapiens
ttccagtttgggataattatgaatgaagctattgtgaacatttgtttacaagtgtttttatggccatgttttcatttctcttgggtaaatacctataatggaattgctgaattatatagcaattagtgtatgattaactttataggaaatatatatggttagtgtatgattaactttataagaaaccgccagacaaatttgccagagtggttgttaagtgtctcatcccactaacaatggagaagagttcccattgctctacatcctcatcaacacttaaaatggtgaaaacgctttaaattgttaatattttgg

SEQ ID NO: 101594 - DNA, 300 bp, Homo sapiens
aaggaagcctgtgttagcttaaaaacccatctactaaaaattcagagactatacatatcagggctctctaaagtcagatgaagggggcacacattctttcacagctcatatcttcataatacttaaaaaatagtcaaatgataccatttcacatataaaacaaagctctagtacactgcagcaatgaataaatggtcattgctatttatcccaaacactctcaggagaagaagcaaatcttactgagaaaattgttagttcagttttggacattctaaatttgaggtgctcgcagaacac

SEQ ID NO: 101595 - DNA, 295 bp, Homo sapiens
tggcaaatgaaaataattatttggtttaaagtatcctccacctccatttcactggatgtcagtaggtggcccacccacccttctctcccttcacacatagcacatagctcaggtgtgaggaaacaagattacataggtaggtgtggaagctgccttgacttaacagcccttagcttcatatagcaactcttctcccatgggcacagcttccacggcctagcaatatgaacacctggttacactctcagggaagcccacatgtggtatgggttcccgtcaggcatttatcctttgt

SEQ ID NO: 101596 - DNA, 428 bp, Homo sapiens
aatctagaacagttcctatcctttgtagtcttttttaatcaacattttaaaaagaaaccaggacagttgtcttgtaaaatatccaacaacctggattcacgtgattgttagttctcatttttgcaagaatatcatataattaagtgttttgtacatctcattttatcatattagggaggcacatgatgttggtttgcctcattattggtggtactaaatttgatcacttaaagtggtgctcactttagtaaaggtatattttactctaattttagcttccactgatgaaggctgcctgcctatattagttattaaactgatggtttcacatcctcacatttttgactgaattgatcatgcaccctactatgaaccaagggaatttcccccccagcttcctagtgaaatggggtatggttgtttcaata

SEQ ID NO: 101597 - DNA, 315 bp, Homo sapiens
ttttcccaattaaaagagccacatcctgctcctagcttatttctattaatgacagcacaagcgtcaaattataagattatgcgtttgggcacccctttttcttctgttctggctaatactttacttgtatcatttatgagtcctcactagtcttcagtccttaatctgatttcaaaaactatggaaatgggaggttcagaggggtcatagcacacgtcaggctggtcacttcctggattacagactttgtactgagtgttattatacaaacatgttccttttggaattactaggcattcataataactatagaac

SEQ ID NO: 101598 - DNA, 150 bp, Homo sapiens
gcggccgcctactactactaaattcgcggccgcgtcggctgctaaatgagaaaaatcactgtttgtttttaaactcaaaggtataagatctttaacttacttttctgccttaagtgtggctgccaaagtagtagagcaagtttcaactta

SEQ ID NO: 101599 - DNA, 872 bp, Homo sapiens
ggcttttgactgatgtagttaattcttggtaattcaccatattaacacatttaagacatacgacaataaaatcatctcataagatgcagaaaaaataattttataaaattcaccagtgactcaaacaaaaaatgttagcaatctatgatgagtagggaaatcttttaatctgaggttatgacaatactcaaagtttcatagtgactgggaacaggaggaagatgcccattattattacctctactctgaatgattctttaagttctagacgttgcagtaaggcaaaaaaaaaacaaaacaaaacaaaaaattacaggtacagaattgcaaggagaatagcatgtctttatttgaagattcaattattgtattcctatgaaaacaaaattatcttcagaaaaacaatttaagaaatattagcaaagtacatggataaaagaaaacatcaatatagtaaaattaggtagtaacttgagcaaaatagtcagaataagcaactacatatatcctctcctccataaaagcattgagaacatgaacaaaaatcctcagaatataatttttcaaaactctggaaataaaagtgtttagcaatctaggtagtgtttattcaatagcaactgaatattggtaagagcaataaacgttgtggtgttttaacttgctctgttacaatttcccactcccagtttgaaggtagcttttaaaataagtgactctggggcgaaaaagggtgatctttcaaagccctattttcagataatttttataattttccctgtatcatggttccaacaaagatcccactcataaatctgtctttattcacagctcctgaagtgtgaacagcttttctaggtttgtttctcaaa

SEQ ID NO: 101600 - DNA, 373 bp, Homo sapiens
ttctttcttgtagtttctttctgctgcagttccccatcttttcattatctacattttccccactagattattttaatcttttaatcacagccattttaaagtccttctttgatagtttcagtgtcttgttaattctctaggcccaattttattgattgtctcttaacaatgtgttgttttccttgctttttgtgtggctcttaacatttgattaaatggaacatatgttgagcagaatagtagagacttacgtaagtagaaatttctcctgcaaatgggcacatcccttctctctagctgtttttatagggtaggaactggcaaactcttgtctgtaaaggaccacataagtaaataccttaggctttgtggc

SEQ ID NO: 101601 - DNA, 758 bp, Homo sapiens
agaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacaccgtttgacgagtaccgtacaggtgagcaaggttgcaagaacctcatccaccgcgagcaagatggcccggtgcagaggacggtttgtctgcccagtaatccttgttcaagggcaaagcacatttgcaggtcggccacactggctggatggggagagctgtatggacgctcaggcctacaactattaacctcagggggttgcagatgatgcctgggcagaatgtggaggacgtccacggaggaggaactgtgcctcttcgaagtggtgacacgcattctttggaaagggtcagaggctatgacttcaagctgctcgaaaacctgtcaatacaatacattctgagac

SEQ ID NO: 101602 - DNA, 395 bp, Homo sapiens
tgagattcagttttttggtctataaaatgtggataagaggtgttcctatgtcctcaggttgctgtgaggattaaaggagataaacttgttgggggcttaacccaatacttgccatacagtaggcactcattaaatgacaatggtgaggatgggtactccatcaataaaagcagtatcaacactaaaatagtaataatagcacctaacatttattaacctatttgatgcccacaggtatctataaggtaggcaaattatatttccatgttacagatgaagcaatggaagcacaggggttgagtcgctttgcccagggtcacacagctaagaagtggcagagctgaggtttgaacccagacatccttgttctggaatctgtgctcttaacctttacc

SEQ ID NO: 101603 - DNA, 322 bp, Homo sapiens
atctgaggtgacacaaagacatttttaattttaatagtcatatttattttaacgtatgctttaaaatgtaataagcaagttgtctattattattattattgctgcttatgatagatgaggccaaaataggtattaaagtttttttcttattttttaaaatttctttttaaaaattaatagagacagggactccctattttccccaggctggtctcgaactcctgggctcaagggatcctcatgcctcagactcccaaagtgctgggattacaggcgtgagccactgggcttggcctgaaggtttaaaagtgagttaataacc

SEQ ID NO: 101604 - DNA, 411 bp, Homo sapiens
tgtgatggagtttcgctctgttgccgaggctggagtgcagtcgccaatctcggctcactgcatcctccacctgccgggttcaagtaattctctgcctcagcctcccgagtagctgggatcacaggcacctaccaccatgcccggctaattttgttttgtatctttagtagagacagggtttcaccatcctggccaggctgatcttgaactcccgaccctgtgatccacccacctcagtctcccaaagtgctgggaatacaggcgtgaccacagcacccggcctacagcatctctttaattaagctcattcatataccttcactgtcaggctaaacgcgatggcttatgtctgtaatcccagaactgtggcaggccaaggcgggtggatcatgaggtcaggaattcaagacc

SEQ ID NO: 101605 - DNA, 377 bp, Homo sapiens
gccccacctgatctccccacccccgggacctccctgccctcatctcccactgccctcccccttcatggctctgctccagccacgctggggatcttgagtttcctcacacacaccaggctgccgccagcttcagggccttagctgtcgccattctctttgcctggaatgttcttagaaatcctcttcactgtcccctcatctcctgcatgcctctcctcaaaggtcacctcactggaggcctcctggccactgtatctaaaacagtagcccctgccattctctgcaccctttcctcacacctgacaatgtattgttatcctgaatatttaattattttttacctgctcctcctccaactcccaatgagaatgtctgca

SEQ ID NO: 101606 - DNA, 388 bp, Homo sapiens
ccgcttaatcacgagtgaagtcaggtcacttaatccatgtccaagagctctcccattgacagttgcctttcctggacagcaggaggctgttgctcttcttgcatgtgtcactgagagaacagatgtcctggagcatagatgggtcatcatcttagatgttggggtccaattctggctagggagaaatttatctcatcctgggaatgggtgggttacttgtatcaaatcctggaactgtccacatcttctgaacccatcactaatgaagaaagagaattctggggcaatggatggatcaagagctcttcaatgaaggtattttatcagttggactaaggccaggttttggcaggggagtcaatgggacaaagggtgagctgtggcttta

SEQ ID NO: 101607 - DNA, 277 bp, Homo sapiens
ttttgtaatttttttttgtagagaaggggttttgccatgttgcccaggctggtgttgaactcctggtctcaaactcctgggtcaacctgccttgagctcccaaagtgttgggatgacaggcgtgagccactgcacctggcagtgagcaccttctaaaaggctcctcgcgggcctcacctgagcctagtcctgggtgagttcctgatctaggactggaaccctggtctcctggccccatgaactgttctggacccctgcgaggtactttttagagtct

SEQ ID NO: 101608 - DNA, 203 bp, Homo sapiens
aaagtcaaatcagaagatgcctgcatcagcctcactgccccccaccgccccagcaggcagtatcttcagatgaggagaagcaactgaggtataaggatctcaggggaagacacacctgccgtggttctcaggggacaggattatctccacggaaaaccccaaagggctaacagacattgctatagctgatgataaggattcag

SEQ ID NO: 101609 - DNA, 247 bp, Homo sapiens
tggcttgctgttgggtggcttaacgactgctatttttcagtccacagaagtcagaacagctgctttccatttctcccacgaagtctttctggggcccagcagcacttatcatggcagggtttgtttagtttgtttacagggttccctctcctgcccctgaagaaaattctagtattcagaaatgtacattgaacaatataacaaacacatggtacccaccgctcaggactagccattgcactccggg

SEQ ID NO: 101610 - DNA, 107 bp, Homo sapiens
atattactttaccatgctaattctctcactagttttataactgttacttttttttttaagtttgctatgtggttaattgtatcatctatgaaaactggcagttttgt

SEQ ID NO: 101611 - DNA, 355 bp, Homo sapiens
gataaaacagctgaaagtctggagaaataagtagcagaatcaaagagcccgaatgatccgcaggctgtatgatcagctcgaaacagccagcaggtgatcaagcaagagacgctgtgaacaatgaggcttggagtggagctgctcccgcgcccccacccctcagagctctgggacgttggggcacagggttacagaacaggcagcaagtatttcttaaattatgtaagtactacttggatatattcttcttacaaaaaatttaagtatcataggcagggtgcagtggctcacgcctgtaatcccagcacttcaggaggctgaggcgggtggatcacctgaggtcaggggttcaaga

SEQ ID NO: 101612 - DNA, 544 bp, Homo sapiens
ctgccttccttttatatatccttttttaatatttatttttatttttaagacatcatgcctaagcccctgccttcctgccagatctggcctcttcagggggagaagtgcaggagatgaccacttcagtctggaagccttcctctctggctgtcaaattctattcaacttcttaggattcaagtttaaaaaaaggcgagaacactctaattgtttccttcctagaatcatgtgtcttttgccccatagcccctcaaagtataaagacgtacaggacatcatcgcttcctccaaaaagttgaagatccagataggggaagatgtgggtgcccacacaaagtcaagactgtttacttccaggcagttatcagctgtgtcatcctgggcaagtaacttaacctcttaggctcaatttctttacctgttaagtgcaaatagtaggaccttccttttctcccaagggttgtgataagaataaaatcaggaagccgaggcaggaggattgcttgaggctagcctgggcagcatagtgagaccctgtctctac

SEQ ID NO: 101613 - DNA, 486 bp, Homo sapiens
acctccagagtcagagaggagaatgagtgagggaggaaagcagaaaggaagtcatcgcccacactcgctgtggcaatagcgcctcacttagcagctccatccccatgttgacacgttgatgaggcccggcccttgcccttgcgtgggtgtgagactgtggctctccatacctgctcactgggcccagagcaatttcctatttttgtgggcagacttgacctagtccaaaggccaaggtctcccgaggatttgacgctaatcccgttggatatttctcatacctccctcatgcctcatctggtattgttcctttctggactgaatagatcttgtttcttcctcattacaagtttctgcctgtgtgaagttttagaaagcttcaggacacattccatatttgaggccgaagccacaaaaagttaatatttggagcggtaggataggagaggaagagctacaggcagaaatctggatttgattaaaaaa

SEQ ID NO: 101614 - DNA, 208 bp, Homo sapiens
aagaaaacaaaagattgtttttcttctttatttgagaaccattttatgtagattgcaggaaggttgtgaattaaaatatgtttagattttttcattccgttcattaagaaacatttgatttaagctgcagagaggatatgcatttaagaatatgtttagaattgtggttgaggtggcaaccaccatgcaattatcagtttattaacag

SEQ ID NO: 101615 - DNA, 313 bp, Homo sapiens
cctggttggttctttcaggtccaaatggagagagttcacacaggacttctttccatttagtatataaggctggaacaaatgcgggacgatcagaacacaatgactcccgaagagatcgttgcctgaggatgtcaatagattcccgagggcaagggcagggtagactgagaatgtttctaaaaggatcttggactcattctggttccctgaggagttacagggaagctgaacaggtgtttgaatcctccttgcctctgagactggccaaatgccacgctttttaaggaagtattggtgcttaaagtcttttcca

SEQ ID NO: 101616 - DNA, 531 bp, Homo sapiens
atgtcttggcgagcgtcgacgaatgaataatcatatctggtgttatcattgcatacaggaataatattaatagcattgtaaactatcatctgacattaaaaagaccattaagctatattataaaacactttataccagtaaatatgacaatttatgtgaaattattaccaaactacacagaaaggaatggaaaatataaatagtcctatattacttttaaaaaactaaatcatttttgtaaaccttcttacaaagaaaactccacatccaggtagcttcgccagtgaatttgaagatgaaataacaccaatttcacacaacattcccaaagaataataaaaagtgataataggtattttcctcttatttattagcacagcataatcttgatcccaaaacctggcaagaacattacaagaaaggaaaatagcagatacatggttgcaaaatgatcaagtaggcttttttccaggactagaagaatggtttaggattcaaaaatcaatcaatgtaatttaccacattaataaa

SEQ ID NO: 101617 - DNA, 524 bp, Homo sapiens
tggcatcagaggagtcctattggagaatgaatgctttcaccacttctaagcagtaaaaaagcctttctctacctatgcaccccaacccccagcacccaggggtattagtagaggctacatgggagcagtagcttctcagccagagacatgtcagtggaggtggagtggagagtcaggattcccacccagcccaggggaatcaagaagctgccccatctgtagtgtaaatggaggacaagtggggaacctgaacatctacccccaacttgccgaaatgaaatggcacctcactatcttcatctgctggagcaaaatcaaacaaagccaactaacacagaaaatttaagtaagatctagagtcttataatacccaaagtgtgcagattttaattaaaaattgtctggctgagtgtggtgactcaagactgtaatcctagcactttgggaagccaaggtgggtggatcacctgagtctaggagtttgagaccagcctgcgcaacatggcgaaacctcatctctacca

SEQ ID NO: 101618 - DNA, 272 bp, Homo sapiens
tcattctttctctcctgccaccccgtgaggaggtgccttccaacgtgatcataagtttcctgaggcctccccagccatgtggaactgtgagtcaactaaaccacttttctttataaattacccagtctcaggtatttcttcatagcagcatgagaacagactgatacagagctggatcattcctcattatgggaggctttcctgtgcattgtagggtgtttaccaatgatgaccgtctgcacaatccctgaaataaagaacagcttgacaga

SEQ ID NO: 101619 - DNA, 695 bp, Homo sapiens
gcaacagatgctgcagcccctcgaggccaagtgacttgagaccttggaggtccaaaggtcacacaactaccttcctggggccccacctggcatcctcctctccctacagccaggacaggctgcccagcctcagaaccaccacttgttgtgactattaaaccccatgtcccaatgatgcctggagaccatgcctcaggcactttacactgttagtggtaatggtgacacattatctgagttttgttgcttgtaaatttcttttatgctgataagcttggaactggattggaattgagtgggggacattgtccagtgtccatcaagaatgtaatggtaaacatttaatgtttttttctccttcttccccacagtatcagttttcttattgaatttgggaagcaatagcaattgattaagttgcagtggagcttgccctaaaaggaaatgattgataatccgtttaggtctggcttgctcgcttttcccctcctgatttccttggccactttttcaattaccaactgtatttagcttggtttgcttgttgtaactcatttccccttcctccaggatctgcagggaagttgtaatgtaatgttagagtagtgacatctaattatttccctgagacatcagttagaaatgtaagaatacttcttccttgaggtgggcagacgagggatgtgagtctgtga

SEQ ID NO: 101620 - DNA, 286 bp, Homo sapiens
agtgatagattttattcacttccttttccattcacaaattagctcagcacctgcaatatcacaaatggccagcagatgggagcaaataactttgcaaaaaataccgaaagcaccaagtcctatgcaagagtatccaattcatcaggtccgtaaactttttaaatttctcaatctttctgtgccttcaaaatttaagtctcaaatgactgcatgttttaattactaagccctaattacttactaggaatgtgatcatttgaggagacatttcattaatatgtgttta

SEQ ID NO: 101621 - DNA, 586 bp, Homo sapiens
aggaagtcttttccatatcttatggtacaattacaaaagaattctatctagaaaaagaacacagcctacaaaagattaaaggcattcagatcaaggtgttttgtcaagatttcctaggtgtcctctttattggtgccgttacaaggtaagtggagacagacataagcaattgctcggcgtagcctctcctacagaagagttacctcaatgaactgagaacattctacccactctcacattccagcttactcacccacatctaccttcatgtttaagagcagcattcagagactataaaagcaaggaatttaagtcttctgctactttaaggcaaattgcatcaagaggactatcacaaaatgcaaacacgatgaaagaatttcctcttctttgcagaacgcaattattctgcattaacaatgtcaagttctgcattcactagacctcccagatttttattcttatccctgtataaataatcaaagctgcatgtatctcagaatgttgattagaaaatactacaaggcaggcatggtggtgcacacttgtagccccagctactcaggaggctgagttgaaaggattg

SEQ ID NO: 101622 - DNA, 517 bp, Homo sapiens
gcttaattcttaatctgaattaatggcttaaatccagtgtcttaatcatggaacagtgtagttaggaaaaatacttggaaaatcagtcttacagattgcagtctattagccagatgtagcggtgtgcacctgtaatcctagctactcaggaggctgaggcaggagaattgcttgaacccgggaggcaggggttgcagtgagccgagatcgtgccactacacttcagcttgggcgacagagtgagtgagattctgtctcaaacgtaaaaaaaaaaatgtggttctgtaacaagagcactatctggattgacatatgtaagaaatgtaatcttgataatatcccagtttcatttagcagtcttttaaaaagtcatcagtgtgattttaaaaatataagcaagtcattgaattatgattcttaatctgtttttgcttctcatacatatactatcctaatatggtctttgaaaataatacaagaaactccagtgtcgaaaaacacagctatcctttctttt

SEQ ID NO: 101623 - DNA, 133 bp, Homo sapiens
cgcacagctgattaagtgggggtactgggctttgaaccgggactatcccagctggtgttctaaacccctattctatgctgcatttttcttttgctttttttctgtgagagggaggaaggggccacttccctac

SEQ ID NO: 101624 - DNA, 795 bp, Homo sapiens
gctttaatatcttcgtgtgaaaatcggtctttgaggtttatgctatttttccctataacccctttttgctgtcttctattaaagctctaggcacagacatttctctcatcctgcacccctcaattcatcagagattttattatctggctcacagtgttgctgtccccactccaggtcttgccatcactatgcctgcggacaatccatttaatatttcactctctaggagcttaatctatgtggagataacaaacatattaaaaacagtatgatacttaaaaataacgttttaaggcatccatagaagtggcataagcctgtgtttgaaacaaagccgtaattgggggatggacacctcttttcttctaggttcacatttccatgtggagggacatcactgtgtaattcccttggcttctctttgcgcccagaggaggacttactaatctcattgaagaatttgggtgagcaactaggcagggcttaggagccagccacttgtagcctattcttggaagctgcaaattttccagaaacagatctctatgtgggtaggcctatagttttccaactgctactgttattgggtgagcgaattgctcaattccagcagacacttatttttttgagactgagcctctctctgttgccaggctagagtgcaatagcacgatctcggctcgctgcaacctctgctttccaggttcaagtgattctccttcctcagcctcccgagtagctgggactatagggcgtgccaccacacccggctaatttttgtatttttaatagaga

SEQ ID NO: 101625 - DNA, 105 bp, Homo sapiens
acgaagagctttgggttgctccttctggcgccaggagcccctacgcagggttaatgatgataagagaagtgagtgtgactcagcagatggaatgttccaatgctg

SEQ ID NO: 101626 - DNA, 413 bp, Homo sapiens
tgttgataacactgaaaccaagctgctaaaagctcatcacttggcttatcatgaggactcataagtaaagcacattgagagtgaaatggaggccacttgagagcggaataaataccaggaataggtgaggccagagttgggggcctcattgcattttgggtgaaggtatgatcctcaaagaagagttgccagtagggcacattcaaatgcgcaagaaggaatttgattaatttcgactaactttaggacgccaaaagtcctgatctggagggaaacattctgcagaaaaaatcatgtgatcaatgatgatactcatggttaggcaacctcattatttggttctctttgtagtaagaatgcagccagtgattatctcattaactgtacacagaccctgagacaagtgataaatt

SEQ ID NO: 101627 - DNA, 102 bp, Homo sapiens
aggtgccagaaaggaggtcaaaaaggcagggaccccaagaagaggaggaagcctatgagtcacctggcagagggaaggaagcaagcctttctcctggtgaag

SEQ ID NO: 101628 - DNA, 8465 bp, Homo sapiens
tgaatgaggaggggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggtaagcgcagccccggcccggcgcccgcgggccattgtccgccgcccgccccgcgccccgcgcagcctgcaggccttggagcccgcggcaggtggacgccgccggtccacacccgccccgcgcgcggccgtgggaggcgggggccagcgctggccgcgcgccgtgggacccgccggtccccagggccgcccggccccttctggacctttccacccgcgccgcgaggcggcttcgcccgccggggcgggggcgcgggggtgggcacggcaggcagcggcgccgtctcccggtgcggggcccgcgccccccgagcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccaccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccctagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcttagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggctaagatttcactttaagcagtcgtgaactgtgcgagcactgtggtttacaattatactttgcatcgaaaggaaaccatttcttcattgtaacgaagctgagcgtgttcttagctcggcctcactttgtctctggcattgattaaaagtctgctattgaaaga

SEQ ID NO: 101629 - DNA, 1502 bp, Homo sapiens
tgaatgaggaggggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaaggccaacacagatgctggctgaggatggcctcaggggctcctgctgaattccatttttcctgttgtcactgcaccctggtgagccctgcagtccttgccgttgatccacctggagcattcacagtgcatgattaggaccccaccccgaagccgccatggctgtcggtgcagagcgaggttaaagagatgggattgctgatgtctcattccgtgctggttgaatttgtagcttttacaagaagacgacgtagatgagaagctgagaagtaagcctaagccccgtgtgtttgactggggctcctcaaggtagtcctaggaggccagaagacataaagaagacacttgagttggggtcagtgctgccatctcagggtgaggccaggtctcacctccagaacccctctgcctctcctcttctggtgccccaggagctggcttcactgcttggaagagagcaccccgaccccagtcctcacgtcgctcctacaggccaggccttcaggccatgctcctcattcctggaggggtccctgggaaagcccaccccatcaccctctgagagatggccagagaccttagaaccatggctctggagccagtctctgggccagggtctcaaaagcacagaaagaagttcaaggttgcctttctctttgcattttaatcatttatttc

SEQ ID NO: 101630 - DNA, 7416 bp, Homo sapiens
tgtcccaggtggagtgggtcgtatggggccggccaagtccctggaggagtgggtcataacaggccagctgtgacctcagaggagtgggccgtatcgggctggtggagaccctgctggagtgggccatatcagcacggccatgtcctctccaagtcaagaaccctgcaaacatgggcgcatttccatttgggccataaacctttattgggaaaagtgaacctagagcttctgctgctttgtttcatgggtgtgagcctgtggttcttactgatgcttctactgagaatggtcctggatttcacctggagagcgccctaaagcttgacagaaagaacggatttagagatcagtattttttccagaaagatgtgcccagtagtatcaggagagaatctgtgggctgattcttacaaatcgccctccaggttccctttctggggactgatgctattattaatcaaattccatcaacaaaaccaaagtccgcgcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccaccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccctagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcttagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggctaagatttcactttaagcagtcgtgaactgtgcgagcactgtggtttacaattatactttgcatcgaaaggaaaccatttcttcattgtaacgaagctgagcgtgttcttagctcggcctcactttgtctctggcattgattaaaagtctgctattgaaaga

SEQ ID NO: 101631 - DNA, 8327 bp, Homo sapiens
tgaatgaggaggggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggtaagcgcagccccggcccggcgcccgcgggccattgtccgccgcccgccccgcgccccgcgcagcctgcaggccttggagcccgcggcaggtggacgccgccggtccacacccgccccgcgcgcggccgtgggaggcgggggccagcgctggccgcgcgccgtgggacccgccggtccccagggccgcccggccccttctggacctttccacccgcgccgcgaggcggcttcgcccgccggggcgggggcgcgggggtgggcacggcaggcagcggcgccgtctcccggtgcggggcccgcgccccccgagcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccaccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccctagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcttagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggcgttgctggaaggtccggctcgatc

SEQ ID NO: 101632 - DNA, 9001 bp, Homo sapiens
tgaatgaggaggggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggtaagcgcagccccggcccggcgcccgcgggccattgtccgccgcccgccccgcgccccgcgcagcctgcaggccttggagcccgcggcaggtggacgccgccggtccacacccgccccgcgcgcggccgtgggaggcgggggccagcgctggccgcgcgccgtgggacccgccggtccccagggccgcccggccccttctggacctttccacccgcgccgcgaggcggcttcgcccgccggggcgggggcgcgggggtgggcacggcaggcagcggcgccgtctcccggtgcggggcccgcgccccccgagcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccaccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccctagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcttagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggctaagatttcactttaagcagtcgtgaactgtgcgagcactgtggtttacaattatactttgcatcgaaaggaaaccatttcttcattgtaacgaagctgagcgtgttcttagctcggcctcactttgtctctggcattgattaaaagtctgctattgaaagaaaaagaaagcgaacagtttttgtttgttttttttgccgtgtgtgctccatagtggaggcgctattttccaattgatgagaatgacaaacatatataatctatctatctatctatctatctatctatctatctatctatctatacagggggcttgaaccttactcacccaagagcttcttacggaatgtggtagaaaaccaagttgtaacgacactgtaacctacctgatgcctgttcgcgcccgccgtgagctgcgcactggccgtggccaccattcacctctgtaatttaatccgtttctcttggattgtctggacgtgcccgatggttctttcttttgctcagtggagttggaggttttgtgtttggttttctcattcttgtcttgttttgtgtgggtggattttcaccgaccaatgatatcctcttctgacggtcaccttctttccacttcactggagtccagtattctgtaccacatcacgcaacgtgttatcttgtggtgtaaataaagactgcgttacttgccactccca

SEQ ID NO: 101633 - DNA, 8424 bp, Homo sapiens
tgaatgaggaggggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggtaagcgcagccccggcccggcgcccgcgggccattgtccgccgcccgccccgcgccccgcgcagcctgcaggccttggagcccgcggcaggtggacgccgccggtccacacccgccccgcgcgcggccgtgggaggcgggggccagcgctggccgcgcgccgtgggacccgccggtccccagggccgcccggccccttctggacctttccacccgcgccgcgaggcggcttcgcccgccggggcgggggcgcgggggtgggcacggcaggcagcggcgccgtctcccggtgcggggcccgcgccccccgagcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccaccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccctagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcttagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggctaagatttcactttaagcagtcgtgaactgtgcgagcactgtggtttacaattatacttttctttgtctggtaccctttttttattgtaacttagtctaacgtgtttttatttagtcttac

SEQ ID NO: 101634 - DNA, 2430 bp, Homo sapiens
  misc_feature (1735)..(1735): n is a, c, g, or t
  misc_feature (1847)..(1847): n is a, c, g, or t
tagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatggtaagatatgagctaccaaattttttcagtgtttaaggacttgagagatcaaaatgtttcttgatttgatacaataagaggtatttttaatatttaagaaatgtttaattgtgtgtgtgtgcatgcgggcgtgccttcagctcttgtacatttatgtcatgaaagattctacttttaattaataggtcttcttggtatcaaatagtaattattacattgagaagctaatagagattcagtaacgtaagagtgattattttttaatatcaaattcattgaaaacctttttttcatattttaatatctgtgaaatttggatgcattttataactgatggcatcttggtacttacagtggtccataaaatcattgcctgtttttgtcaacttagatttggtgaaatagagatgttaaaaaaactttgttgttaaagttataatttgtatcctaggattttctgaattctatattggagttccggatagtctcccagatgattcttaactttggtttttcccatctcaaattctgcaaggttatttgtgttcttgtgttcattttgatattttatgaatataggaatgttaatttggttattctgtatttgagtatctacagattttctaatttaattgttgagcttctttaaggaatatagaaattggttgacatgtattttatttgatgtctttacaagaagctagacaaaagcattgtccctaatatatatttatattcttttttgtccagtggactgaatatatatctggatctccagtttttgttgttgttgttgttgttgttgttattgttttttgaggtgaagtctcactctgtcacccaggctagagtgcagtggcacgatctctgctcactgcaacctctgcctcccgggttcaagtgattctcccacctcagcctcccaagtagctgggattacaggtgcccgccaccacacccagctaatttttgtatttttagtagagacggggtttcaccatcttggcctggctggtctcaaactcctgaccttgtgatccacctgcctcacctcccagaatgctgggattacagacatgaaccaccacacctggcttggatcttcagttttctatctaaaattgcaaagtttccaatcatttnactcatactatgctttaaaattaggttgaaccatttgagatggttgctatttggctatttttgaactctaaaattagcagtttcatacgggtcaaactaaattgaatatctnctttttaggtttagtcctttcagggtgttggtactggaaattaccttttcaggaaagttataccatttgtcccttggtgtctgtggtggattgttgccaggccctaccctctctgtcccctagaatacccaaatctgaggatgctcaaggcatagtatttgcatataacctatgtatatcctcccatatactttacatcgtctttacatatatttagtataatataaacatcatttaaataactgttatactatattgtttagggaataataacaagagaaaaatttgtacatgttcaatgcagatgcagctattttttttaaatgaatattgttttgatctatagttgaatgacgaagcacagagccttccataggtatggagggctcatcattgtactttgttgttgaatttacttagatttagtgtaccaaagaactgaagtttaaaaggtcacttaattggtcgtttaattttctaatttttttggatccgcatttggttgaacattttaatttagatagcaagaggaactgaataacccttgatacaattttgaaataaagtatttacacattctttg

SEQ ID NO: 101635 - DNA, 2028 bp, Homo sapiens
tagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctgtaagttccctaaattttttttttcctggatttaaaattttaaagaattgttttccaaaagtaaactgttgttatttatgaagctgttattataatttgttgcatgctgtttaaagtaacaattgcccagaaatagaaatgataaaattcaagaattcagaactaatgttaaacttatgaaaatctgagtcttaaatcttatgtggtttcagctttctgtgtgtattgaaagcctaaaatatacaatgcagggatattggccatgaatttactgtgatatacaatagtatgtcatgtccttggtagacatctaagcatttctaactttgtgcaattcacattttagaaattatactttcagcttacatgagttatttgggttcaatttgcaagtatccattcaagatagggtaatttattttgagaaaggagtaaaagaaagctgattcgctatattgcacatatatattgggaaattgtgccaagtttcccaggtaaaataaatttatgggcatggtaatacttgtttagcttttaattttggtataattttaaactgcaataataataaaaaaatttctgtatctactctactcagattaatcaattattgcatattgccccattactttatcattcattcttttccactacatgtatacatatttttttctgagtcatttgtaagttgagatatgttcctttattcctaaatactttgatgtgtatttcctaagaacaaggctattgttttttgaagccacagaaaaattactaaattcaggaaatataacattgatacagtgcagttcattttcacatttcatcatttgtctcaggtttcccaacctcatcactatggacattatgagccagataattctttgttgtcaggggctatcgtgtaatttataggatgtttagcagcatccctggctactagatgccggcagcttgtggtctttctccttcctctagtgtgacaactataggtgtttcctggtggggggcaaactgcctgtagttgagaacctaataatgtcctttctagatattttttcctggtccagaatggtaatactttgatacttcataaaattggctccaatacaatatagtttgtaggttgttaaggaattgaaggttaaggaattgtgctctatttcttcagctaagggtatggtctttgctaactacatgctgtggtcagcatatagctgtggttttttttgttgtttggtttttttttctggctgttgatctgactttttttttttggcgtgggaatgtcctggagtgtgaacaagattagtttaaaaagttccctatgacttgaagatgttagattaaatgaaaaacttaaataatgtaacctagctcttaagcattaatactggagtttttgtcattgacatcagatgtctttaatacaatggtaattaaggaaaggagtggtaaatattttgtgggctactgaaggaaattatatagacaaattctttattctgtgaaatactggaataacaataggatgtatttgtatagatatgttattttgaatttttttccttcatgttattaaaaggtatcttttt

SEQ ID NO: 101636 - DNA, 893 bp, Homo sapiens
tagtttctcagaagaaaagaccgataagaaaagggagataaaaccagtataatctcttgtgtgcttttcaccttcgaggtacatttctggcccgacaaaaactactgctcttctggtttctaacaatatggaggtccttagaattgacttaaagtgtttgaatttattcaaatacagattctgtatttagtggaattttgtaccacaacaagtaagattatagtattggagggaagaaagtctggtataaaagtgtactttactgtccatacatgaggaagtgacataatttatgttttcaaaatctggagtaattctttgtgaaaaagattttgtaagggtatgggaagttgctgtttgctgcttctctgtgttctcacagcaatctgctaataagtataactcagctattagaagtagtaaggacagcgttgtagactgattaggggaaaagccagtgtgagttaaaaaaattactttttaacattttttaaaaagaacttatttttaagcaaagtttatatggtaaactaaactaagctagttaacatgagtccctaggcattctgttctaatgtataggtaagaatgactttagtttgtaattagtgtggtcaaaagaatgtaaagaaatgttttaaaatactctgatactgcttaaatttttattttcctaggtagtttagtattctctcattacctgttttggtttaaaaaaaatctttcggtaatgcaaagataaacttttggctatgcgttatctgagttacgtattctgaatcatttgaattcaaatgtagtaggtattaactattaaatatgctccatatatgtgaagtatttttcccttctaagtgcttatagtgactgtgtgttggctgtcttttatgaga

SEQ ID NO: 101637 - DNA, 598 bp, Homo sapiens
ttgccacttaatatttaagatgtgattacttagaataataactctcctttccttaaggattaatcagttctttcaagtgcttggagctttacgtatgaaaagcataatataaatgtgttgtcagtattgtcataatggtaatgatgaccacatcaattaaaaccatctgttttcatcctaattttctgttatgtggttcttaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccaggtgggataaaacttttgttgaaaatagttgtattattcattttcttagcagacagagcaaaacaaaggatgttcatgacttgaacaggagtgacacctttaaaacattttaaaatgtgaattttataaacttaatcttaatgtgtagc

SEQ ID NO: 101638 - DNA, 2032 bp, Homo sapiens
tagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccaccgaatgtcgacatctcctccagctcagattccaccactggcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagacgaatgtgtccggatggatagaaccccaccaccacccactttgtctccagcagctataacagtggggagaggagaagatttgacttctgacatcctttgttagagcaagtggaatgacccgctgtggcatcagtcagtgctcagtaattaaatatacatcagagagagctgcg

SEQ ID NO: 101639 - DNA, 1877 bp, Homo sapiens
gagatcacgccactgcactccagcctgggcaacagagcaagactcccatcttaaaaaaaaaaaaattgccctgattactaaccaatccatgccattgtttgcatatgtgcaaataactgcccaaagaaatgagggggtctgtcaaagataaaggcttctcctttgggttccttagccacagtttataccattgattgcctaactgcagctcggtgtgaaattcagtaacatggaagcaagaaatggaagcctatgacctaatatgttttcttccttagatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccaccgaatgtcgacatctcctccagctcagattccaccactggcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagacgaatgtgtccggatggatagaaccccaccaccacccactttgtctccagcagctataacagtggggagaggagaagatttgacttctgacatcctttgttagagcaagtggaatgacccgctgtggcatcagtcagtgctcagtaattaaatatacatcagagagagctgcg

SEQ ID NO: 101640 - DNA, 1502 bp, Homo sapiens
ttgggaggctgagttgggaggatcacttcaggtcaggtttcaagaccagcctggccaacgtggtgaaaccccgtctctactaaaaatacagaagttagccgggtgtggtagcgggcacctgtaatcccagctactccggaggcagagacaggagaatcgcttgaaccagggaggtggaggttgcagtgagctgagatcatgccactgcaccccagcctgggtgacaagagcaagactctgtctcaaaaaaaaaaattttttttttttcaaattactcttgtttggaaaacttgtaatagaattctgatgattatgaccttctgataatgaacactttttcctttagagtgatttaaaaatttctgtatttttgaaatcagtactaattgtcatttttttctctcacagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccaccgaatgtcgacatctcctccagctcagattccaccactggcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagacgaatgtgtccggatggatagaaccccaccaccacccactttgtctccagcagctataacagtggggagaggagaagatttgacttctgacatcctttgttagagcaagtggaatgacccgctgtggcatcagtcagtgctcagtaattaaatatacatcagagagagctgcg

SEQ ID NO: 101641 - DNA, 1544 bp, Homo sapiens
ttgccacttaatatttaagatgtgattacttagaataataactctcctttccttaaggattaatcagttctttcaagtgcttggagctttacgtatgaaaagcataatataaatgtgttgtcagtattgtcataatggtaatgatgaccacatcaattaaaaccatctgttttcatcctaattttctgttatgtggttcttaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccaccgaatgtcgacatctcctccagctcagattccaccactggcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagacgaatgtgtccggatggatagaaccccaccaccacccactttgtctccagcagctataacagtggggagaggagaagatttgacttctgacatcctttgttagagcaagtggaatgacccgctgtggcatcagtcagtgctcagtaattaaatatacatcagagagagctgcg

SEQ ID NO: 101642 - DNA, 576 bp, Homo sapiens
gagatcacgccactgcactccagcctgggcaacagagcaagactcccatcttaaaaaaaaaaaaattgccctgattactaaccaatccatgccattgtttgcatatgtgcaaataactgcccaaagaaatgagggggtctgtcaaagataaaggcttctcctttgggttccttagccacagtttataccattgattgcctaactgcagctcggtgtgaaattcagtaacatggaagcaagaaatggaagcctatgacctaatatgttttcttccttagatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcagatcaacctctccacttctcctacacctgcagtcgacgcgg

SEQ ID NO: 101643 - DNA, 708 bp, Homo sapiens
ctccatatatgtgaagtatttttcccttctaagtgcttatagtgactgtgtgttggctgtcttttatgagagccttcctagcagtttagattactgctgattatttctttggaatgaatattctttaaagctcataagataatgcttttaccaatacaaacactttgtgtgacctgccagatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtatttcagctgtagtgatgggtagtctaagacttaagatgtcatattactttttgcttaagctggatttatgtattgtttcatattctcaaatgtacagttagaattactaatgtttcaatcaactgtctcaatccattttgtgtggctatagcagaataccaagactgtgtaattgtaaagaaaagaaacttatttcttacatttctggaagctgggaagtctaatatgaaggagctggcatctcacgagggccgtcttattgcctcattccgtggtggaagactagagagcaagataccaaatttgcagcctcaagcccttttaaaatttcctttagtcggccgggcgcggtggctcac

SEQ ID NO: 101644 - DNA, 675 bp, Homo sapiens
ctcctgaccttgtgatccgcccacctcggcctcccaaagtgctggaattaacaggcgtgagccaccgtgcccggcccactgggtagttttaatgtgtacaagttagtgatttctagtgatatgtaactaggaaagaaataatgttaataagcttgatgatattatgtattaaagcagtgaaattttaaactgccacttttttatactttgattttctgattaagataaaggttgagattatggtttgacattggttcaattgacttatcacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggtaagactaaaataagagtttatgagatcaaagtttctgttatctgtaggtagttactgaaaataaatagattgggtattatttcagagttctcagatgtcctgtggttatttttcccggaggaaatatattaataggttgccgaatagaagttaattgagaaaaaggggatatgtttttttatgttactctgtttctagcttttgtctcagtgctttttatccagattgaagaaatgctatgcta

SEQ ID NO: 101645 - DNA, 2081 bp, Homo sapiens
tagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctgtaagttccctaaattttttttttcctggatttaaaattttaaagaattgttttccaaaagtaaactgttgttatttatgaagctgttattataatttgttgcatgctgtttaaagtaacaattgcccagaaatagaaatgataaaattcaagaattcagaactaatgttaaacttatgaaaatctgagtcttaaaaaaatctttttgtattatttcttgtatatccatttgcactgatcatgttcagatcttatgtggtttcagctttctgtgtgtattgaaagcctaaaatatacaatgcagggatattggccatgaatttactgtgatatacaatagtatgtcatgtccttggtagacatctaagcatttctaactttgtgcaattcacattttagaaattatactttcagcttacatgagttatttgggttcaatttgcaagtatccattcaagatagggtaatttattttgagaaaggagtaaaagaaagctgattcgctatattgcacatatatattgggaaattgtgccaagtttcccaggtaaaataaatttatgggcatggtaatacttgtttagcttttaattttggtataattttaaactgcaataataataaaaaaatttctgtatctactctactcagattaatcaattattgcatattgccccattactttatcattcattcttttccactacatgtatacatatttttttctgagtcatttgtaagttgagatatgttcctttattcctaaatactttgatgtgtatttcctaagaacaaggctattgttttttgaagccacagaaaaattactaaattcaggaaatataacattgatacagtgcagttcattttcacatttcatcatttgtctcaggtttcccaacctcatcactatggacattatgagccagataattctttgttgtcaggggctatcgtgtaatttataggatgtttagcagcatccctggctactagatgccggcagcttgtggtctttctccttcctctagtgtgacaactataggtgtttcctggtggggggcaaactgcctgtagttgagaacctaataatgtcctttctagatattttttcctggtccagaatggtaatactttgatacttcataaaattggctccaatacaatatagtttgtaggttgttaaggaattgaaggttaaggaattgtgctctatttcttcagctaagggtatggtctttgctaactacatgctgtggtcagcatatagctgtggttttttttgttgtttggtttttttttctggctgttgatctgactttttttttttggcgtgggaatgtcctggagtgtgaacaagattagtttaaaaagttccctatgacttgaagatgttagattaaatgaaaaacttaaataatgtaacctagctcttaagcattaatactggagtttttgtcattgacatcagatgtctttaatacaatggtaattaaggaaaggagtggtaaatattttgtgggctactgaaggaaattatatagacaaattctttattctgtgaaatactggaataacaataggatgtatttgtatagatatgttattttgaatttttttccttcatgttattaaaaggtatcttttt

SEQ ID NO: 101646 - DNA, 431 bp, Homo sapiens
accaccacccactttgtctccagcagctataacagtggggagaggagaagatttgacttctgaacatcctttgttagagcaagtggaattacctgctgtggcatcagtcagggcttcagtaattaaatctccatcagatccctcacatgtttctgttccaccacctccattgttacttccagctgccaccacagggagtaacagtacatctatgcacagtagcattcccagtatagagaacaaacctccacaggctattgttaaaccacagatcctaacccatgttattgaaggctttgtgattcaggagggattggagccatttcctgtgagtcgttcctctttgctaatagaacagcctgtgaaaaaacggcctcttttggataatcaggtgataaattcagtgtgtgttcagccagagctacagaata

SEQ ID NO: 101647 - DNA, 1344 bp, Homo sapiens
tggcaaggtggaaatcaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccaccgaatgtcgacatctcctccagctcagattccaccactggcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagacgaatgtgtccggatggatagaaccccaccaccacccactttgtctccagcagctataacagtggggagaggagaagatttgacttctgacatcctttgttagagcaagtggaatgacccgctgtggcatcagtcagtgctcagtaattaaatatacatcagagagagctgcg

SEQ ID NO: 101648 - DNA, 1879 bp, Homo sapiens
gcagagcggcgggtggggagcggcaggcgggcagggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccaggtgggtagcgggagaaggtgtcccggctgcggggagcgagaacccggcccagcgcctccctggtgggcagggcctggagcgggcgggggcggaggctgcggcccgagaagcccgcagagacaggctggggccagggatcgcctcccgagaggtgcctaggccgtggcccagagtcgcttccccactgccccgcccaccagccaggcgggggccagggatcgcctcccgagaggtgcccgggccgtggcccagagtcgcttccccactgccccgccctccagccagcccctgcccgacctcgcagaccacctcagtgcgcaggcgactgccctcgccaggccgcgccgccctgcctcgctcaccccgccccgcgctgaccccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaaggtaaggtcttgagtgttggggcaaagaccgaggtccctctcccgctacgctgctcggagtggtcacctggagaagagatatccttttctgggtagatcttcctaatttaactcatcttctggctgtggaaggaccattttgggggcagggaggttgggtgggctgatgaacacacactggttaattagcaaaagggtgtgagcattcctggggacacagggaagaaagtgaaggtaaccccaataaatttatataaattgtggaccctgggacctcagtcccactcagcctcctcctgcctgctctgaacctcacagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgcgtgagtccagcctgcttcaggagggaggcttcgggcacaggcacgggcacagccctacttccaggcaggcaaatccatgcaggacaagcagaggggttgctggaggtgacaaggattgggtcccacataaagcagtcaggaatccacatggtgtaataaagagactgggctttagccgggcatggtggctcatgcctataatcccaacactttggaaggccgaggcaggcggatcacctgaggtcaggagttcaacaccagcatgaccaacatggagaaccccatctctactaaaaatacaaaattagcagggcatggtggcgcatgcctgtaatcccagctattcgggaggctgaggcaggagaattgcttgaacccaggagatggaggttgcggtgagctgagatggtgccattgcacttcagcccgggcaacaagagcgagactccgtctcaac

SEQ ID NO: 101649 - DNA, 2389 bp, Homo sapiens
gcagagcggcgggtggggagcggcaggcgggcagggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccagcccctgcccgacctcgcagaccacctcagtgcgcaggcgactgccctcgccaggccgcgccgccctgcctcgctcaccccgccccgcgctgaccccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgctcagacatgcaacggctccacgcccctgcacctggcagcccgtgacggcttgctggactgtgtgaaggtcctggtgcagagtggcgccaacgtccatgcccaagatgccatgggctacaaacccattgacttctgcaaaatatggaaccaccgtgcctgtgcccggttcttgaaggatgccatgtggaaaaaggacaagaaggactttgcccgtgagatgacgaaaatgaagatgttcaagagccagctgaccctcatggagcacaactacctgattgagtatcaaggtcaaggatgcagtgtgcacttcccatttgccttttcccccatcacaccagagactctcctatggcaggacatttctctactatcagactgtggattcctttggagaagaagggaattgtctttctaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacaatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgagggtgctctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaagttattatggctacctctccccctgaggcagcccagtgaaggctgaagtgtggcaattcacgttgtgggtggcgaggaaagggggaggggtgcctatgggcttcccactcccaagctcgaggagtcacccttcccaatcaaaagcccagaccccaggcctcccttttctctgcaaataaatctcttggcacccccccaccgccgccaggaaatccaagttaggttgagagtggggggtcagacactattcttcaccttggcattgtaaaagttgtcacattttggcacccccactgccctcccagccctaagggcccaggcttccaggatggaaggacccactgggaaattctgtttcttgttcagattaagcccttcctgctgcaggctctaagctgagacccagaatggggtggagggcaactaatatgtccccctggcatgggcttccctgctactct

SEQ ID NO: 101650 - DNA, 2439 bp, Homo sapiens
gcagagcggcgggtggggagcggcaggcgggcagggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaaggtaaggtcttgagtgttggggcaaagaccgaggtccctctcccgctacgctgctcggagtggtcacctggagaagagatatccttttctgggtagatcttcctaatttaactcatcttctggctgtggaaggaccattttgggggcagggaggttgggtgggctgatgaacacacactggttaattagcaaaagggtgtgagcattcctggggacacagggaagaaagtgaaggtaaccccaataaatttatataaattgtggaccctgggacctcagtcccactcagcctcctcctgcctgctctgaacctcacagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgcgttcttgaaggatgccatgtggaaaaaggacaagaaggactttgcccgtgagatgacgaaaatgaagatgttcaagagccagctgaccctcatggagcacaactacctgattgagtatcaaggtcaaggatgcagtgtgcacttcccatttgccttttcccccatcacaccagagactctcctatggcaggacatttctctactatcagactgtggattcctttggagaagaagggaattgtctttctaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacaatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgagggtgctctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaagttattatggctacctctccccctgaggcagcccagtgaaggctgaagtgtggcaattcacgttgtgggtggcgaggaaagggggaggggtgcctatgggcttcccactcccaagctcgaggagtcacccttcccaatcaaaagcccagaccccaggcctcccttttctctgcaaataaatctcttggcacccccccaccgccgccaggaaatccaagttaggttgagagtggggggtcagacactattcttcaccttggcattgtaaaagttgtcacattttggcacccccactgccctcccagccctaagggcccaggcttccaggatggaaggacccactgggaaattctgtttcttgttcagattaagcccttcctgctgcaggctctaagctgagacccagaatggggtggagggcaactaatatgtccccctggcatgggcttccctgctactct

SEQ ID NO: 101651 - DNA, 641 bp, Homo sapiens
tcagactgtggattcctttggagaagaagggaattgtctttctgtaagacttgaggttttccctagggcagggactgtgtctcccatgtcaagttggagtctcacctagggcagaggctacatctctcccatcagattggagatcccccctttgggagaggtgctttgtctccccactcagcccaggggctcccttatggaaaaagttgtctcccccatcggaacaccggctcccataaggcaggtgttgcttccatcagactcagactttccctcccatcagactcagagtttccctcatccttcagactgtggtttccgaaagctacagccacaggacctccttgcccagaagcagagggcagcagtcctccatgactctcttgtgccctctgttgttgcagaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtc

SEQ ID NO: 101652 - DNA, 2122 bp, Homo sapiens
gcagagcggcgggtggggagcggcaggcgggcagggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgcgttcttgaaggatgccatgtggaaaaaggacaagaaggactttgcccgtgagatgacgaaaatgaagatgttcaagagccagctgaccctcatggagcacaactacctgattgagtatcaaggtcaaggatgcagtgtgcacttcccatttgccttttcccccatcacaccagagactctcctatggcaggacatttctctactatcagactgtggattcctttggagaagaagggaattgtctttctaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacaatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgagggtgctctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaagttattatggctacctctccccctgaggcagcccagtgaaggctgaagtgtggcaattcacgttgtgggtggcgaggaaagggggaggggtgcctatgggcttcccactcccaagctcgaggagtcacccttcccaatcaaaagcccagaccccaggcctcccttttctctgcaaataaatctcttggcacccccccaccgccgccaggaaatccaagttaggttgagagtggggggtcagacactattcttcaccttggcattgtaaaagttgtcacattttggcacccccactgccctcccagccctaagggcccaggcttccaggatggaaggacccactgggaaattctgtttcttgttcagattaagcccttcctgctgcaggctctaagctgagacccagaatggggtggagggcaactaatatgtccccctggcatgggcttccctgctactct

SEQ ID NO: 101653 - DNA, 1910 bp, Homo sapiens
actcagaagatactgggaatcttaagtgaatcctgaaatggggagggctttggggctgctgactccggcacaccgggtctgtttcagttccatttctctccagttctcagccctatcctcctctgatgtcagggtcaccagtcctcagagtcacacactgtccagaggaggcaaggcccatctgtttcctgtagctctaaccttttccagaagctccttgcatcttccctcatctcttatggcctcaattcgatcaagtgtccattctcgttcctttagctagaactaaaggaaagccatatgctgactgacttaggtctggggcaaggtctgatggaattatgatgattggcttagcccaatcagagcctgtgcctggagctgggtcaatctccaaagcctctgattgcttagcaacagtctgggatagtgagacaatggcggtgggggaggttctatgacaatatatggaaggctccgtggaggcaaggacagagctagattgagttgctgccaccgggcctggagagccagccaactgtatcctccctacatgacttctcaaggcccaccacttccaagaagcgtgtccacatcaggccatccagtcctttctgctttctctttccagggtcaaggatgcagtgtgcacttcccatttgccttttcccccatcacaccagagactctcctatggcaggacatttctctactatcagactgtggattcctttggagaagaagggaattgtctttctaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacaatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgagggtgctctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaagttattatggctacctctccccctgaggcagcccagtgaaggctgaagtgtggcaattcacgttgtgggtggcgaggaaagggggaggggtgcctatgggcttcccactcccaagctcgaggagtcacccttcccaatcaaaagcccagaccccaggcctcccttttctctgcaaataaatctcttggcacccccccaccgccgccaggaaatccaagttaggttgagagtggggggtcagacactattcttcaccttggcattgtaaaagttgtcacattttggcacccccactgccctcccagccctaagggcccaggcttccaggatggaaggacccactgggaaattctgtttcttgttcagattaagcccttcctgctgcaggctctaagctgagacccagaatggggtggagggcaactaatatgtccccctggcatgggcttccctgctactct

SEQ ID NO: 101654 - DNA, 305 bp, Homo sapiens
tgtgtgtgtttgtctgtgtgtctgcatgtgtgtgtactggaggcagcgcgtaatcatggaggtgcttccacaagatctcagaaaaactcaaaagaatgttctaggatcttagggatgggttttcccaaagactcaactcttcccttttaagctgggtcctctgatgccacatgcagaattgctggaatatttgcctccttccgggcgttagaaaacagttgtgttttcattccttgaacactttggtcacttagagcctgagccaagacctaagcaccaataccacattggactcaactcatgga

SEQ ID NO: 101655 - DNA, 713 bp, Homo sapiens
gtcaattctttcttcccaggaggcaagaattgaagttgctgcagatccatattaattcccagccagtaacagtagatcttagtgaggcatgtataggtgtttattgcacttttctttcaatggagggatggtaagagcatggcacagaattcctaatgtgtgtttcaagggcccaagcaccatgtgaatcaagaaccaacttctttggaaacttcaagatgctggtcctaacagtttgttctgcttgttcaactatcgttcctagggtcctctcactaaagcaaggtatgtgcttatccgattatgttctttgcatctctgtttcttggacaggtattacagaatggtgattttgcagctaaacagactcaagcttaaatttttgctctatcacttcattagctgtatgcccttggtcatgttacttaacctctctgagccacagatttctcactcgtaaattgaggctgaaaataggtgactgcctcttaggttatggaaggcacttagctctggaaagtgtttatgacaggcagctaaaattgttctagggtaggagagatggattaggtgagactgcttcttaccatgaggaatttcccttctaaatggaggtcagccatctgctgggggaccaggatagctacgctgctaattgagggtttaatttgtcagccacaaaaaaggtctctgggagttgtggttacttaatg

SEQ ID NO: 101656 - DNA, 103 bp, Homo sapiens
agagtctgcatttacgaccacgtgatgacaatggtgctggtctgtggctcacattttaagtgtcagctgtccttcggagcctttcttggtaccaggggctgag

SEQ ID NO: 101657 - DNA, 1329 bp, Homo sapiens
agctgaggcgcctggtgggttcccacgtgcgtcctccgccccccaccctcggttttaataaccgtgaaaaaaaaaaaaaaaagatgcgtttcccgaacgtgggtacttagcaatacctagtaactaatgattttttgggaaattaaataagatcaaattataagcaatgaacatttcagatgtcgatttaacacagttccaatggaaactgcttgcctgttatctttagttcgtgggggaagcactgtagaagtttagaaatggctagagacatccccagattcccaagcagaatgaaaacttcctttccgaggaaaacacaaaatgttctcccacatcacaccccgcctgcatttatcaaaaaagaaaacacctgatgctggctgtgtgctgttggaaccagaaactttttagcatattatagtcgagtgccagtgacttctttgttctttcagaggcattctaaaaagcggcgtgtttcacgaatctcagagacaacaactttcacaactatcaactgtcacctcccaaactgccacagaaccttttaagtccaacattctgtcatttgtgggaaatactcatcttctaaaacacactctacttattctttgaatagtagttgcaaagctagtcatctctcaggaagcactttctatttccaaaactttggtttcatcagtacctggagcaaagcttctggcagaaacacaaatcctcatcaggggagaggcacaggatcaactcacggttataaactggactcctgctctgacgggtagcagccatcaactttgcccgattctcataattctgaagggtcaccaaggagttgctaccagccactgtacttaaagtggtgtcacaggattacaaaatagaagaaagtctttcttctctgactaatatgttagtgctctagtaagcatcaaagatgaaagacacacaatgtgagcctgctttggccaacacaaagtacttacagaattttcaggcctacttccagccctggagacaaatttcccatcattcttcattacaggagtaatcatcctcatagggctgtaatagcttttttttttttttagatggagtctcgctctatcacccaagctggagtgcagtggctcaatcttggctcactgcaatctccacggcttgggttcaagcgattctcccgcctcagtctcctgagtagctgggattacaggcgtgtgccaccacgcccagctaggttttgtattttttttagtagagacagtgtttcatcatgttggtcaggctggtcttgaacccctgacctcatgatctgcccacctctgcctccca

SEQ ID NO: 101658 - DNA, 311 bp, Homo sapiens
cttatgctaggattacattatgctaaatcaaaagtgcattttttatataaaatatttccaacttaccatgggtttacctggatgtaatctcatggtaagtggaggagctactgaatgcgtattgcttttgcaccactgtaaagctgaaactcgtaagtcaaaccatagtaaatcagggactatctgtgttaaatctaatcttgttcacttcatttcctcactaaatttgccagatcaaactacaatttaatccctgttcttctgtctccctccatctctttcttccttcctccttccttcccttccttcct

SEQ ID NO: 101659 - DNA, 149 bp, Homo sapiens
gagcgagaccttgtccctaagaaaaataaaaatcagggttgtaaagaggaggttaacactcatgctggtcacctctaatgaagacctaaattagagaacaggacagacaagctgggttaggaacagaatccaaaaagtgtttcttaagt

SEQ ID NO: 101660 - DNA, 416 bp, Homo sapiens
aggtcagatgtagcatttagggctgaaccagccattccaggttctctagggcttttgttaatgggatacacaatcattctggttcagacattcattccctagaattgtgagaagacagagtcctcctcacttcttgaaggttgatgctcttgaattaaagaaaatctgaagtaagtcagtgactcacagtgaggtacgttattatcgacaccaaaccaccgtctcaaggatttgattgttgctataaatcattgactgaagcatacctctggttcatgtcacaataccaaatgcacttaacaaaagctaaggatgatctcatttttatgactctcagagtgcacaagcagcacttatgtattcatctacagtgtatggatttttcttgctcaacaggagactagaatttgtcgcat

SEQ ID NO: 101661 - DNA, 213 bp, Homo sapiens
atttagatgtgctagtaacatcatggtactttttgaggttgggataataagtaaacagaagtcttttaagattttgatgcagggaacattaacaggagacagaatttggagtagcaggagaatttgaaaatgttaaagaaactttgtccttccaaagaaagccaaaaatattatttgcacttcagtctgcatttgtctggaatgcttacaaaa

SEQ ID NO: 101662 - DNA, 156 bp, Homo sapiens
caaaaaagaaagaaaacacagctgaagcctaattttgtatatcatttactgacttctctcattcattgtggggttgagtagggcagtgatatttttgaattgtgaaatcatagcaaagagtgaccaactttttaatatttgtaacctttccttttt

SEQ ID NO: 101663 - DNA, 232 bp, Homo sapiens
tcgctctccttctttctctctttctctctctctctccctccccctcctctctctcttctctctcccttgacaagcgctttttcatttgcattcctgagttctcttaaccttttacttagagaggtgcagtatggtttagagtaaataaatttaaaaagccaagaggcttgggaatgatacaattatcactgaattctggtgtcccttcttaccccgtgtgagactctgggca

SEQ ID NO: 101664 - DNA, 397 bp, Homo sapiens
attgatccctctcttcaggaatgatcgacagatagtccagaaagcataggctgtagattttgttccagaacctcctgggatcatcagattgaacacatgagggtgggagactgccatacaagctgggaaggaggaatcagatgatattgtcatgaattcctcaagagttagtgtttgctggcctccaagaggcaaggatctctgggaacttaagacagagaagcacttcacactcacccatgagctcttttccgtgggtctcaactgggcattcacaacatagattggaagtaaggtggagacccaaaatttgtgatcagacatgattaccttccacagtgtgtggcctgaaatctcacccccctctggaggtcctagattgtcctccagagccttc

SEQ ID NO: 101665 - DNA, 590 bp, Homo sapiens
ctgccccctggaacctgagcaagaagaagatcctagtgggcggagtggggagggaaagtgttctggagagttttacttgggattctggtatttgggtttctgtcactgtctcttctccctccaaagtcaactaatactcagacattaaggcttaagaccctgttaaggggaaaggtctatgctttagagaggatgctgtagagtggtaggcaaccatcattcctcttgtgaatattgtggtcattgcattatgggccttcattgaattatgaaccatcatgaggatgagatccaaaccaagctggatggaaaccacatggatgaggccccagagagtgaggacgccatacaaatgtaatcactgagctgtctgaatcatcttgagaaaattctacaagtctgtatacatctgacttccccatcagttacacactttgaaaggaaagctctagggagaagagtaccatttgcttccccaatgctaggagaggaaggtgatgagaccgagattactaactaaattatttcctgtgacttcttagaaaagctgaactcccaaggtatgccgcttggatatggggacgcgcaca

SEQ ID NO: 101666 - DNA, 255 bp, Homo sapiens
gcttctgtggtccctaatcactagatgccagtagaactattcccgcctccgacttgtgacaattatttgtctctagagattaccaaacacctcctgaggaacaaaatcactctgatttgagaaccactgatcccatattaaaggtccatgcctgtcatatagtgctcaacgaacaatggttaaatccacggtcaccattgctttaaaaatgagaaaggagccaggcgtggtggctcatgcctctaatcccaacac

SEQ ID NO: 101667 - DNA, 316 bp, Homo sapiens
ggtgacatttagctgagattgaaggacaggaagtggacagatcagtgaagagcaggctggagaatattctagaaagaaagaacagctagcctaatggccctaaggtaggatgccctcagtgcatccagtgactggaaagaaaggcagagtggccaggacgtggatggggacgtggatgaggtgggtgtcaggaggtgcagggctttgtgtgcctggggagaagttgggattttatgcttaggtgataggaagccgctggagggttttgagccagaggtaaagtgatgtgatggttttctgttttttgttttttgtt

SEQ ID NO: 101668 - DNA, 372 bp, Homo sapiens
ggaagcctgaagagtgttttcacatattgactcagcttgccaactctttctccttcaatgtttcaggtgtcagtggctcctgtagttattagcaatggcactaaactaaaaatatgattggtcctattataccagacatggaaaactgaaataacgagccagagcaatactatccataattgcatagacatttccttactgaatacacactagttctctcaaattattggtctagtttgacaaagtcccaaaggtgtaagtagctaatgtacccagttaaagtgaagagaaattggggacgagagaatgattgtcaaaacacttctctgatagaaccttgaagaatataagacttagagtcacttgtataga

SEQ ID NO: 101669 - DNA, 355 bp, Homo sapiens
agattgttactagcagacctgccctacaagaactattaaagagagagtccttcaggctgaaatgaaaagacattagagagtaactggtaaatgtactacataggtaaataaaaatatagcataaatgtattttgtttgtaaatcatttattctcttatttaaacacctacttcataaagcaagaattataaaactgtgtttatgggcttacactgtgtaaagatacaagttaattgacaaaatttcacaaaggagagagaagaaatggagctatatggaaacaaaattttagtacactattgaaattaagtcggtagtaatttgaactaaattgttctaaattgggatgttgatc

SEQ ID NO: 101670 - DNA, 307 bp, Homo sapiens
gcagacacctggtaactgcaacctgaactcccaggtgagtgtcccactagctggaaggaaaaacaagcatggagaattcacaaaggaaacatttatagaatccagaaaaggcatttactttttatggggagcaatgcacataaaacccaagactccaggaagccctttgtgcttcatgattaagaggctggggagccccaagcctccctgctaggaggtcagagtggaggtgtgtgagtgcaggaaaagtacgtttcaggccccagactcgctgatatcactgatgtgtagacaagaaacttgacaa

SEQ ID NO: 101671 - DNA, 409 bp, Homo sapiens
ctagaagtactacctaacacaattgccagtacagagtagatgctcaataagttgctgattaaattaaatttcagaggaagtaatgtgataaacacctttaggtaaagcactgagacacaaaaagaagaaaatggctatgctgtcagggagtatataaatcaataatggtagcttccatttattgagtcctaactatggtattggcactgttcatatagtatgccatttaacactcatagcaacccagtgaagtaggtgttataacccctagtttaagaatgaaattaagtaacttaaacaagttcatagaataaataataggattcaaacttaggtccctccagtttccaagcctgtgctctttcactatacatgatgtcagctgggatctagccaggaaaaaaaaaga

SEQ ID NO: 101672 - DNA, 330 bp, Homo sapiens
tctggtaagattggcctggagtttccatttcttacgcttttctcagcagttcagtgtcagggttttttgttagcattataaaaggagatgagtatttttctgttttttttttctcctcagttttcagagtttacatagatttccaatatactttttgtgagtttaggacaactacaaaattagatgatacagtctccatataagactattctcacttctgacaccaactgtaagcttgggggattcccaaaaccactctcaggtttgataattcattagaaaggctcatagcatttagtgaaagctgttgtacccatagttatgatttgt

SEQ ID NO: 101673 - DNA, 847 bp, Homo sapiens
aacaagactgtgggtggtttaggtgacaaagaaaagttcaggactatggatagttcatttgtatgcaaatatgttagtcactgtgcatatttcagtgaaaaattagtaaatgacttcataaaatgcaagataattgggaaacaccaaaacgggtgaattctaagttgttttgcaaactttatatagatgtgttgagcaaatcatattttaggctgccagtttttagtcctgtaaaatgcattaaaaagtgctggccatatatcttggattttgttttctctttgtagaatttaattccagatttgctttgatctcattcttgtatttacatcttgctcctttgtttaaactgtcttcttttatttacaatatgcagagagggaagcaggtttaagtccaattaccataatttctgcttgacttatgtgcacttaagcagtttaaatcttgctttggtgacaggagacttttccttcaggattccacaataaatccttccaaactgatgaataattggattcacagtcagtcccttcagtgcacaaaatacttaggttcctgggtctcactaagtttgaggagcaggccttgcatctggaacacaagtcaacagtagaaacatcccttggctgtgccaagtccctaacacatcaaactgctatgcacaattccctttctctctgaaaatatcatgaattctcaactgctgaatcaagtgcaaattccttagcttgaaatttcttaaggttcttcatgaagtggctccccacttttactgactcctgttgtattaccctcagatcaaatgtttggcttcggtggggtctttctctgttccatctccaag

SEQ ID NO: 101674 - DNA, 338 bp, Homo sapiens
agactcagaagtcaggagccttggccaggagcctctgcagtggccactaactgcccttgtagctgtgtttcctcctggccaggcccagggctcagagaggagcaagccagggttcactctgccctggacccgggtggctgaggacggcaggccccagtcctaaccagcaaaggtgcttccagcccagcccctccccccaactagggccttttttattttttatataagttactctgggatggggagggtggttattgtgggggctgcccctccccctgcacagtagtttgtcctgtggtttattttgtattacctgtaaataaagtggctttatttta

SEQ ID NO: 101675 - DNA, 435 bp, Homo sapiens
tttaatagctttactgagatgtaatttacataccataaagttcacccatttaaagtacacaatttagaggaggtttctcgtatacttagagagttgtgcaaccatcaccataatctaattttagaatattttcatcatctccagaagaaaccttgtacccattagcaatctctccccatccctcccccagataactgctaacatggagggactttaacatttgaatccaaacaagaagaagaaacctttagtattcaatcacctgacacaagttcttcattttatagaggaaaaaagtgatgttagagaagggccatgattttatagaggaaaaaagtgatgttagagaagggccatgttagagaagggtgagatgtggcagaactggggtggatcacagtccctgatgtctacatcataatggcagtgctgtga

SEQ ID NO: 101676 - DNA, 394 bp, Homo sapiens
gcataattattattattattattgtagcgacagggtctcgctttgttgcccaggctcgtctcgaactcctgggctcaagcaatcttcctgcttcggcctcccaaagtgctgggattacgggtgtgagccacagcactcggacgaaaacattttttaaacatgcttccaggatatcttttatgtgaatatggctcagtttagtcatgcccccattcctctttgtcccttactttgctattatcaataaccctgaggcgggtttcttatctctggaatagcagtactatctccctggtggagtcgtcctgaaaatgagaggcaatgtgttcaaagtgcccaatacgtgactgacgtattcaataaaagggagctagtattcatttaacagctgaga

SEQ ID NO: 101677 - DNA, 734 bp, Homo sapiens
aagaaaagtagaatgaaggaaagtataaagaggggtcaaagaatccagtcagtgctaagatatttgacccaggagaaaagaagaggggtgctaaatgacaagaacgcaaagactgatgcaaagggctcctgaagatgcttcagaattttggcaagtctcctctgtccctactttttgtaggctttcctccttccggacactttagtactccttcctgcataccccctcactgtgagcacagagagagagatcttggaaggcaggtggaaagcagcagaataaatttcaggaggaagtaaaagtcaggtgaagggaataaaaatgagacttagcctaatatccagaaaagggattggactagatggagcaggaagagaaatagctatgcaggtgaatatactgaaggaatttttaaaaggtagccatgggtctacatattgaaaagatccctatattagaaaataaaaggccaatctctaatcctacctgtacagcagagacactctggcatgagtccttccatctctttgggccgtaattggggcttcactcatcaataagatttatattcctaagacttaaggttacttccattatataaataattatcttcagacaatactataaacggggaattaccttaattaagtttttggaaatgatggcttatgtatgtttctataactccctagcactctaaatttcctcctggggtgattcaactacaaagaaga

SEQ ID NO: 101678 - DNA, 4203 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactg

SEQ ID NO: 101679 - DNA, 926 bp, Homo sapiens
  misc_feature (874)..(874): n is a, c, g, or t
  misc_feature (880)..(880): n is a, c, g, or t
tcgcaggtggaggccgggcgtaaatcggacgaggcgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtggggggggaacccaagtaatgggggtttaaaccttcgggtggttaaattgtgaaccggtggtgggcggggttngggaantgggggggaaaaatagttggagggggggttgaaaggagacggtgaa

SEQ ID NO: 101680 - DNA, 997 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccctgcgtgtatgtggacagcgatatatcaatggtggtgtgtcgtcagcggactcactcagtcatcctctcattcccaaacattcacgcatccgtgcacacatccatcacttcacaggttctttcaaacacgatgggagatcttccagtgggggtcctcaggttatcatcccaatggttacagcatcaagcttggttcttcagttatcctcagtactttggtgcccatgtagcaagggttcacggcttgatagatctacgatctccgcccatatcagtacaacaacactcatggacctcaattgggcatagcttactactaatctccagacacgatccttccccacatgctgttacactaagtccccctattagatcacagacagacacaagctactacttcaatactgtgtgaaccctacatctcccagcaacgtggtccatgaacagacacgacataaactctaactctgggttgtacccaagcaatcaaattcacgcggtgtaacgtctcctgaataccccctttaaatcccggaaagaatcagtcttaggatttccaagacagatattacccttaccgttattctgactacacccccatgtcaaaggtctgatttgtcacacgggcgtgtgcgaagctggtgaatccgttttccatacaacttctaagtatttcaaacttccatccacagaaagggcataatccacaagacacaattgagttcagacgtgtcagtccatccatgtaaaaccgtccccttcaaacatattcataagacaa

SEQ ID NO: 101681 - DNA, 344 bp, Homo sapiens
gcagccactactactactaaattcgcggccgctcgacaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactg

SEQ ID NO: 101682 - DNA, 890 bp, Homo sapiens
cccacgcgtcgcactagttatacaggctatgcccaccctaatagaattaatggtttgagctgactgggctctggtccttccaagatacaaccaaaagccatcactgctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagctgcgagtcacatactccacgaggcacattcgaatcagaaatcccagtcaatggaccttcagtccttaacatctgagcaaatctttcagaaatgtcttcgaagaagtgcaaacctcaagatggcttagaaaatctcagaatggaggaataggctacccaggatacgaggatgttcccaaaacacaaatacggccatagacgaggacacaaagatgcagattggaggaacaacaggggagtgtgaggagagatacccaaaaaatgaaggataaaagtaccgggatatgtaaac

SEQ ID NO: 101683 - DNA, 1081 bp, Homo sapiens
ccagagatactgtacatgaggtcgatacttgggatttaatagttagtacgagggtctcctttgacttccgattcactgggcgcttgttattactctgagctgcccccagggtccctcccccgccgccagcagcccatttggagggaggaagtaagggaagaggagaggaaggggagccggaccgactacccagacagagccggtgaatgggtttgtggtgaccccgcgcgctaatccctaacacatgaaggagacaacacgtaacgcatgaaataagcgaatgaacagcattcgagcggggggcgatcgataagtatatgagacaagaaggatctacaaccgtggaagtggggttgaacaaagacacactccaaccgacgcacagcgtactaatacctcaaaacacatagaaaaacagaagaccacaccacaaacgcatgcaccgagatgaatgaaaaaagcaagaaaacaactaaaccagcaggagaggaatcacgacagagtaaacacagacaacgaagggaaacaacaaagacacacggaaggaggaaagaagacaagaatagacactacagaagaccaattaagagacagagacaagaggataccagagggatataagagcgaaatggcgaaagagaaccctataaggacaactaagcagacagtcatacaaggagaaaacacaaacagacaagggaggacaaccagtagggggaccaaaagaagaagaaagaaataaagataccagcgaaaaatatccctaaccgcaaacgagtggattgactacaattaataatcccgccattatatagagcacaccaaccagagcaaacagctagtaacatacatccacaatgctggttagtgtaaccactaaatatctacagcgaactagtttgagtggcatcaatgtgaactgacgccaacaagatattacaaacacatcaagggttagttacacacaaaatacaacaacacgggagtgataagaactactagtagagccaccaattataaagcaggtagacgatcccaggaataggagtaccaacgagacatatgacataatacatatagg

SEQ ID NO: 101684 - DNA, 6062 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101685 - DNA, 6041 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101686 - DNA, 5229 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatga

SEQ ID NO: 101687 - DNA, 6090 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttatttttaaaaaaaaaaacaacaaaccaaagttgga

SEQ ID NO: 101688 - DNA, 5060 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctagagtgtggttctcgtcggg

SEQ ID NO: 101689 - DNA, 4247 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaccccccccaaggggaaaaggccccttagggtgggggggggaatgggggggggctcgggtttcccccggggaaaacacctgcggcagaagggcggaaagagcccctaatcacgagaatattagacaaggggcggcgtcccaaaataatgtggtcacccggtggtagtgtgacaagcgtgggggaggagacggcggaaaacaaagaaataccttcgtggttttaaggttattaataatacttgtactatgtgggttcaaaaatacgggtagctttgtgaaaaaaaaagtctcagaccaaaagaaaccaaatttatggtgggtccagagtggggcacagaaaaaaaccccctccgtatggttggtgggttgtgacgccccaaaaatgtggcccagcgttgtggaacatatgttccgaagggtacactaaccaagacagaacttcggcacttggcggacagggaataggtcaccacgggaaaacctgggaagaaaaaaaaaaagggggccgcgaagataacatgggcgccagagagagaggacaaaccggagggcaaacgggggtcaaggtggtagcaaccatcaa

SEQ ID NO: 101690 - DNA, 3729 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaatccctgaccctccttctagctggcaagcatacagtaccatgtggcaaaggtcgacgcggccgca

SEQ ID NO: 101691 - DNA, 5589 bp, Homo sapiens
ctagaggtatccccgccattgtgcgtttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101692 - DNA, 5298 bp, Homo sapiens
gacaagaatgtgactaggtacgaggctgggtggtggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101693 - DNA, 5293 bp, Homo sapiens
aattaaggctagtacgagctggtgttgaatttggccgaggccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101694 - DNA, 5300 bp, Homo sapiens
aggaagtcattagcaggtcggtcccggtttggtattcaatcagcgggacggtcgtcacatagtcagttactggactcttggccagtcaagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101695 - DNA, 3288 bp, Homo sapiens
  misc_feature (3271)..(3271): n is a, c, g, or t
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaagtcgacgcggccgcgnatttagtagtagtaagc

SEQ ID NO: 101696 - DNA, 6215 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagtagagacagggtttcaccatgttggacaggatggtctcgatctcctgaccctcgtgatccacctgccttcgccccccaaagtgccaggattacaggcatgagccaccatgcccggccaactaccatatttttatataggatgaagaacttgggacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101697 - DNA, 5849 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcagacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101698 - DNA, 5759 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101699 - DNA, 4626 bp, Homo sapiens
gctaggtagcgaggctgggtgtatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101700 - DNA, 4477 bp, Homo sapiens
gctgaaattgaacagtaccgcctgcagagggagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101701 - DNA, 3031 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaactggacaccagctggtcttgtccttggggtatactgggccctggggatcccttttcaacccggatgagtggcgctattgaaag

SEQ ID NO: 101702 - DNA, 4237 bp, Homo sapiens
tacggcttaggagaggccggtgtttatcggccgagggaagctcctagagactacagacacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101703 - DNA, 3299 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccccggattgtggattgcctggttacaaaccccaggagctaagaattttattcctggtcctttttcattggaacccaacatttgctggggcagaattgacgggattcaccacccagcacatggggcagtaggtaagccttgggtgcctttgcctgtggaacctaacttaagggggacctttctgggtcccgcgcccatttgggggcacacggacggttcctcggagaacagtgttaaggttacgaaacgctataggggccaatttgaattctcccatttgcaagttggggcttcaacctcttggcaaagcgggcctggagcaaaatttttcgactacgaactcttgaatccaatggtgccatgaaaaatagcccctttggggcctataaacacatttggggggaccacaaccagataggtgacagccttgcgcggcaagaccctgtgtaatataacaccccaaggtctgttgatatcctctgggctacactcccacacttggctgcattgaatctaacccagctgggagggtacacccccccgctgcggtgagaagtctcccaccatgctttgtggagacaacccagcgtgagacgtagctgcacgcatgt

SEQ ID NO: 101704 - DNA, 3874 bp, Homo sapiens
  misc_feature (19)..(19): n is a, c, g, or t
caaagtaaacatcggctanatgagctggggttaatcggacgaggagacactggtggaatatgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101705 - DNA, 2993 bp, Homo sapiens
  misc_feature (2794)..(2794): n is a, c, g, or t
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgntgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggca

SEQ ID NO: 101706 - DNA, 3955 bp, Homo sapiens
  misc_feature (220)..(220): n is a, c, g, or t
ggtcactgtcatatgtggggtatgtgtggggaatggggcacgtggaatgatcagttccttcgtatgtgaagtcaggaaaggcttctggaaccagggagttatagacgttatatggagttatagaaacacagtggaaggggtggcgttagatactgttcctgcctcaggtgagtctgactgggtctcagtcttttctcatagagaagaagaatggctaatnccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101707 - DNA, 2469 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgtggggtggttgaatttcttcaagtacattggagggcctttaaccctttctggggattggatttaaaacttatgatgaatacaggttcgttggcagctgtggggtaagtgggagaattgtgccggccctgtattcaaattataacttttgtgagaggtgagagtggttttggaacattggcatggaattcccgttgtgaacgagtttgcagatgggaatc

SEQ ID NO: 101708 - DNA, 3553 bp, Homo sapiens
tgctaggacagggccgggtgttaatcggccgagggaatactcttcagcaggtctcccaagcacaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101709 - DNA, 2260 bp, Homo sapiens
  misc_feature (2107)..(2107): n is a, c, g, or t
  misc_feature (2110)..(2111): n is a, c, g, or t
  misc_feature (2114)..(2114): n is a, c, g, or t
  misc_feature (2116)..(2116): n is a, c, g, or t
  misc_feature (2119)..(2119): n is a, c, g, or t
  misc_feature (2122)..(2122): n is a, c, g, or t
  misc_feature (2127)..(2127): n is a, c, g, or t
  misc_feature (2129)..(2129): n is a, c, g, or t
  misc_feature (2131)..(2131): n is a, c, g, or t
  misc_feature (2135)..(2136): n is a, c, g, or t
  misc_feature (2157)..(2157): n is a, c, g, or t
  misc_feature (2160)..(2161): n is a, c, g, or t
  misc_feature (2171)..(2171): n is a, c, g, or t
  misc_feature (2176)..(2176): n is a, c, g, or t
  misc_feature (2178)..(2178): n is a, c, g, or t
  misc_feature (2186)..(2186): n is a, c, g, or t
  misc_feature (2195)..(2195): n is a, c, g, or t
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcaggaanggnntcngnagngcncctcngngnttgnnactctggggggtggccccgtnggnnttccagccgnggtcngnggtcaagngccctggtncccgcgggtggggggccccccagggggctccccgcctgggtgactccgccctcgggggcgcccgc

SEQ ID NO: 101710 - DNA, 2382 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagggtatggtggtgccttatgacttaataactccaggttggagaattattagtatctcagtataacaagttcgtgtacacacagaactcgaaaatggtatagatgatgcggatcagaagctgttctcagaaggctttggtctgtgattggttgattgggagaggaattccccacctgccttacctgtctgtctagaaagattcaaatcctacttatttacagatggtctagatgtaatcttgataaaatcaaaccaacttgacttctcctaattcaacata

SEQ ID NO: 101711 - DNA, 3513 bp, Homo sapiens
gtagagacggggtttcaccgagttagccaggatggtctcgatcttctgaccttgtgatccacccgcctgggcctcctaaagtgctgggtttacaggcatgagccaccgcacccgaccaataccttctctctcttttatagcggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101712 - DNA, 3456 bp, Homo sapiens
ggacggctacggcgtagggtggcaggcacaatctccgggggcagatgaaggtaatcacggaggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101713 - DNA, 1902 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagtcaaaaagtcttcacgacttcgaggggatcctctctagagtcgccgg

SEQ ID NO: 101714 - DNA, 4914 bp, Homo sapiens
tcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacatgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaacccagatcagaagatctggccatgctggggctcacattctcacctagcaacaactggctggagctgggcaccagctctgcctttagaaggggtgtccacttcaccaggtcaccacagcccacactacgccctatgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101715 - DNA, 3128 bp, Homo sapiens
  misc_feature (2)..(2): n is a, c, g, or t
anccacttcctctcctcccacctccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101716 - DNA, 3141 bp, Homo sapiens
tgcggccgccccaacatcagaatggtaacagatcaagcttggttcatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101717 - DNA, 3222 bp, Homo sapiens
gatcatctgaatttatactgaatgagttactgtaagtacgtattgacagaattacacggtactttcctctaggtgatctgtgaaaatgttcgctaattcacgtgacccggagtaccccacgaaatcatgcaaaagtggtccccgggttaacccgggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101718 - DNA, 2160 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggtaagggattttcttgctggtgagaaaaggagcttgcctgcgccactggcaagaaagtagaaggtgtgggagagaaatcaatctgcctcactggaatgctttttctgattttctttctaatttattcaattaaaatgtgggggagattccaactgcaagagccagtgggaacacttgacttatggttactggttcctgaaccacttagaacagtcatggtaacccagtggggaaactatctggacttgggttgctttcttgaattgcttggggacaagaagttttgattaaggtagagagtttttggctgtaagaagtatcattgctgagtagagggcaagagggaaggaaggtaggcagcctaaatgctgagtcagtataggctaatgtaattggttaaggggagga

SEQ ID NO: 101719 - DNA, 2908 bp, Homo sapiens
  misc_feature (2)..(2): n is a, c, g, or t
  misc_feature (36)..(36): n is a, c, g, or t
  misc_feature (59)..(59): n is a, c, g, or t
  misc_feature (64)..(64): n is a, c, g, or t
tnactccccttttttcccttcctccctcccctcccntcccctccccttccttccctttngtttncttccttcctttcctttccttccctttccctttcccttccttctttaccttcctttccttcctttccttctgtcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101720 - DNA, 2124 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggtgaaactgagggatttttggagtagaaagtaggatatttattgtttaaacttaaagcatatctttatttttcaaaacaaaactgtaaattgtcatctacaaagattatctctagatacttgtttacttttaatgagggtaaaatatatttcttaggtttttaattacataagtcagcatgatccagagacatgtgaaagaagccaaaagagaaaagtcatctttaatttcattgcccagaaataccactcttaactctgtatttatccttgaagctttttcctatgtgcatgtgtgtgcaacaggctcttcctgtgcagattgttttataacttgtttcttcatttaatactatgttgtaaacatttcccaataatttttttttgcacctagcactgattccccataatttttaataatggcattattattctattctttggacaaaatgtcttttatgtaatgaaaatgttcttatggaaatgttgtgcttgttttgctattacaagtcgtgccattgcactccagcctgggcaacgagcgaaactctatctcaaaaaaaaa

SEQ ID NO: 101721 - DNA, 2742 bp, Homo sapiens
gttttagccagtctggacagagctatgatggcagttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101722 - DNA, 2368 bp, Homo sapiens
agtactctgacatccttataccttatgcgtgggatgtgctaggaaatgggcaagaggacagtcagtgggccaggatcggagccacacccaagtgctaaggcctaagcagacccccatgaggggtacaggcccagccaggggtgccagccatgtgcctctgcctaggcaatggcccagaggagctagcaaacttggtaaatatagaaaaataaaaaccttggatacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101723 - DNA, 1512 bp, Homo sapiens
  misc_feature (28)..(28): n is a, c, g, or t
cccccaaaaaaagggaaaaaattttttnccggggggggcccaacgagggctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101724 - DNA, 1328 bp, Homo sapiens
agataccaagacagagcttctctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101725 - DNA, 974 bp, Homo sapiens
tccataatgtgtgcccacacggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101726 - DNA, 744 bp, Homo sapiens
gcattgtggtagtgcctgtgaatagccactgcactttagtctgggcaatacagaccctgtctcttaagaacagaagaaggactgcttctgtcgtgaagctccttatggcagtcttttggaggggattgattccagcaccctcctcaggtaccaaaatcctcagatgttcaagtctgttacataaaatggtgtagtatttgcatataacctatgcacatcctcccatatactttaaatcatctctagaatacttacaatacctaattcaatgtaaatgctatattaatagttggtatactgtattaagggaatgatgacaagaaaaaaaggtgtacatgcaccttttggtgcagtacagatgcaaccatccattttttttcctctaaatattttcaatccatagttgtttgaatccacagatgtggaacccatggctgcagagggctgactgtatattcattgcacttctctgcttgtacaggacccagagcagctacaagataaatccaatgagattctgactgccataatccaggggatgaggaaagaagagcctagtaataatgtgaagctagctgctacgaatgcactcctgaactcattggagttcaccaaagcaaactttgataaagaggtaagttttttgacaataaggtatagattcagacagtaagggatgaaagagttgaatgaaagttttttgttttgttttcttaagtttatggtttagaaagtaccacctac

SEQ ID NO: 101727 - DNA, 648 bp, Homo sapiens
tttttcctctaaatattttcaatccatagttgtttgaatccacagatgtggaacccatggctgcagagggctgactgtatattcattgcacttctctgcttgtacaggacccagagcagctacaagataaatccaatgagattctgactgccataatccaggggatgaggaaagaagagcctagtaataatgtgaagctagctgctacgaatgcactcctgaactcattggagttcaccaaagcaaactttgataaagaggtaagttttttgacaataaggtatagattcagacagtaagggatgaaagagttgaatgaaagttttttgttttgttttcttaagtttatggtttagaaagtaccacctacttaaaagtatttgtttccagtttagtcgagttcgtattgtgtgagatatccccatggagtgtttgccgtttctcatcatgcttttggaaataaagtgtttctaagcttaggtttttccttttgcagtccaaagtgtggaatgttgttgggtttttttaaattatagggcatggtggtgcatactggtactccagctacttcagaggctaaggcgggaggattgcttgagtccagttattcaaggccagcctgggcaacaaagtcagatatcgtccctt

SEQ ID NO: 101728 - DNA, 379 bp, Homo sapiens
gatcttgaactcttactcatttcacagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaaggtcggtgagaaatactgtctggtcagggaatgtctttggaatgtaggcatttcagtggccttaaataattgtcacccaggctggagtgcagtggcacgatcttggcgcactgcagccttgaaatcgtgggctcacatgatccttccacttcagtgcccccacagtagctgggactaacagatgcacaccaccatgcccagctaattt

SEQ ID NO: 101729 - DNA, 1134 bp, Homo sapiens
  misc_feature (220)..(220): n is a, c, g, or t
  misc_feature (1076)..(1076): n is a, c, g, or t
  misc_feature (1083)..(1083): n is a, c, g, or t
  misc_feature (1094)..(1094): n is a, c, g, or t
  misc_feature (1098)..(1098): n is a, c, g, or t
  misc_feature (1104)..(1104): n is a, c, g, or t
  misc_feature (1109)..(1109): n is a, c, g, or t
ggtcactgtcatatgtggggtatgtgtggggaatggggcacgtggaatgatcagttccttcgtatgtgaagtcaggaaaggcttctggaaccagggagttatagacgttatatggagttatagaaacacagtggaaggggtggcgttagatactgttcctgcctcaggtgagtctgactgggtctcagtcttttctcatagagaagaagaatggctaatnccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagagagcggcgcgcaaaggaaggctggtatgagtaagtagcctgttcgtaaacacatnggcctgngaagaaaccgngttnttttanaaaanaaacgttctccggagagaaaacttt

SEQ ID NO: 101730 - DNA, 919 bp, Homo sapiens
caataagcgtaggagagctggattaaatcggcagagggaaacacccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgtggggtggttgaatttcttcaagtacattggagggcctttaaccctttctggggattggatttaaaacttatgatgaatacaggttcgttggcagctgtggggtaagtgggagaattgtgccggccctgtattcaaattataacttttgtgagaggtgagagtggttttggaacattggcatggaattcccgttgtgaacgagtttgcagatgggaatc

SEQ ID NO: 101731 - DNA, 837 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccctcccacgtgaggacaagaagaacagtcatacctggaggagggcaaggagatcctggtgggcgaatgtgggccagactgtcgatgatccctacgccacctttgatcaagatgctgacagataagtgactgccgctatgccctctatgatgcaacctatgagacccaaggagagcaagaaggaggatctggctgtaatcttctggtgacccccgagatctgagccccttcaggagcataaatgaatttatgccagactccataggacgccgatcaagacagaagctgacagggatcaagcatgtacattgcaagcaacactgactacgaaggaggtcagaagagaaccaggctgaaaccgtggcagaagaatgctgggtgggcatgcgccgccaatctcccttggaggtgcacagccttttgtcatgccccatactagaaaccccttgacgtgggagcattttggtaagtcccaaaaccttggcccttggggagttgcaaagatgcaccttactgcacagaacagaggagctcgagtatccacgaatgtgagggaacgctatacccatgtgcctaaaaacccaagcttggatacatccatcaaacttcaagataggatacac

SEQ ID NO: 101732 - DNA, 664 bp, Homo sapiens
  misc_feature (589)..(589): n is a, c, g, or t
  misc_feature (616)..(616): n is a, c, g, or t
tatgcggtgctgccaaggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatccatatctgctgccaagaatactgtattagtgaactagttaagatagaacatttaaaaaatattcagactttgcaagattctaggctgtaaaaaatacaaaggctaaaaacacaaaaaagtttacaaaattttgcaaacccaataaattgaaatgagtaagaaataaagcaaaactactactgcaggagaggtcaaagagtatcagtaagttttaaaataataacactaaaatgtaataaattctacttggagacgcatcatgtctgccaagggggtgccacggacaggtcagcattcanttcttcaaatcggcacgggtaatgganggtttagaagtcgattccttcatagaaagaatcgatctcaatacttgg

SEQ ID NO: 101733 - DNA, 6009 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggtatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101734 - DNA, 6010 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaactcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101735 - DNA, 6039 bp, Homo sapiens
agccaagtaacatatgccagttcaaggctggtttaatcgccagaggtcctcgctctgagcactctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101736 - DNA, 5798 bp, Homo sapiens
agccaagtaacatatgccagttcaaggctggtttaatcgccagaggtcctcgctctgagcactctgagctgcccccagggtccctcccccgccgccagcagcccatttggagggaggaagtaagggaagaggagaggaaggggagccggaccgactacccagacagagccgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101737 - DNA, 5289 bp, Homo sapiens
aactaggctagtacgaggccgggtgtgattatattgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101738 - DNA, 3486 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaaggttctcttccaggaaagttagaataggtgtttgtcttggcagtgcaatggatgctggtgggaaggaaggaggtcagtgggggtgttgaagagtgcttggatgaggaatgggtggttaacccttgcgtcttgcttgtgtgtgcgaaagggggttaggaaagggggggggaatagaggttcaagggggttaaggtgtggggaaaaaaagttgggggtgtgctgtgtttgggttga

SEQ ID NO: 101739 - DNA, 5990 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101740 - DNA, 4852 bp, Homo sapiens
aggccgggaggtgaatcggacgagcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101741 - DNA, 5001 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101742 - DNA, 4614 bp, Homo sapiens
tcgcaggtggaggccgggcgtaaatcggacgaggcgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101743 - DNA, 3241 bp, Homo sapiens
  misc_feature (3183)..(3183): n is a, c, g, or t
  misc_feature (3190)..(3190): n is a, c, g, or t
  misc_feature (3201)..(3201): n is a, c, g, or t
  misc_feature (3205)..(3205): n is a, c, g, or t
  misc_feature (3211)..(3211): n is a, c, g, or t
  misc_feature (3216)..(3216): n is a, c, g, or t
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagagagcggcgcgcaaaggaaggctggtatgagtaagtagcctgttcgtaaacacatnggcctgngaagaaaccgngttnttttanaaaanaaacgttctccggagagaaaacttt

SEQ ID NO: 101744 - DNA, 4391 bp, Homo sapiens
tgtcagattatcaaacaggatgatgagagatgtcagattatcagacaggatttctgtgattggaaacagaagaaatggcaggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101745 - DNA, 4118 bp, Homo sapiens
ggttgggctctgagactaccttgctcatccctgctatactgcacatgtgcctatagtacgttcaggatgagattggtacataatctggaggccagatccggttaggaatccactccagtgaccatgacgtctttactcttggaccaatctatcacaccatgtgcttcttgactagtgcctactctgaatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101746 - DNA, 2927 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacaccgttgagtatacaacccagttcccttcgtccgctcgccaatgtgcacttagccaagtgggctatgtctgtcattctgtagctcgcttgtgaacctagtgcctgttgcttaaaaggctgggagaagggggagcagtgccctaatgaagagagtggcttggggaaaactgtagactattgtttttgctctgcttcttctttcttttttttgttttgagaccttctctcaaaacaaaaaaaa

SEQ ID NO: 101747 - DNA, 3877 bp, Homo sapiens
caaccccggacaaggtgatgaaggagctagacgagaatggagacggggaggtggacttccaggtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101748 - DNA, 4323 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatccaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgtgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttattttta

SEQ ID NO: 101749 - DNA, 370 bp, Homo sapiens
tttgctggtagacgcacaccatcacatcctacataatatttagctctgaggcgtttccagatgggaagtgcgtttctgtattttcatagccgtgttctctacgtgaatggactggcgtgaagctgggggctgacggctggcagggcagaacaacttccagtaaaagaaggcactgaggtttaagtgctacgtgggagcagttgccgatttttgcaatgggaggctgcatagattcaagtgtgagaattcgaagagattcaaagactatatcaccaccatggtcttgccagaatctgccctctgagtcatttcttaatctactgattatctgtagaaccagccttatataaacaaggaagcatctagcagg

SEQ ID NO: 101750 - DNA, 198 bp, Homo sapiens
gctaaagggaccctcattgggcaggaccttgagaactacatgccagggagaattcagatctctgtcagccccagaacaccagcgggggtggctggaggccacggttgggaggtccctcactgggccagaccttgaggcctccatgccagggagaattcaaaactctgtcagccccagaacactggcaggggtggctgg

SEQ ID NO: 101751 - DNA, 296 bp, Homo sapiens
atagtccccgcctggctaccttaatcttaattgcaggaaaagacagtatagaaacacggatttaaaaacagcagcaacaataaaatgaaaaaacataggcagtgccaagatgcacaaagagagaacggtttcaaatatcacactgaacttagctttccttcagttgatccataaggcctgctataccacatcattccaagaaacaccaagactttgtagctttgctatggacactatcagaaaggtcagttggtttgatcaaaattgtggttgtgtagcttcagccattctcatag

SEQ ID NO: 101752 - DNA, 541 bp, Homo sapiens
atcataccttctcttacggagcctcttccacatttatggacccttgtgatcacattgggcccctccagatagtctctctgttttaaggtcagctgactggccaccttaaattccactgcaactttcattcccctttgccaggcaaaataatgtagtcacaggtgccggggatgaggacatggacactctttggggagtgtgaggggagggtgctttattctgccaacccaaataaccaagattaaaactggacaccaattaaaatctaaattttaggcgacttattttgaagcttaatagcccctccccagcccactcccattaatagcatccatggagaatggacagagtgaattgataatagcatccatggagaatggacagagtgaattgataatagcatccatggagaatggacagatgaattgattcatcattcattttaaactgttgtctcattctgacaggacattagagaaatagctcagcctcactcgtctattcacagagccagtttttccattctccattcagattcact

SEQ ID NO: 101753 - DNA, 274 bp, Homo sapiens
cctctggttcctaggtgttttctcttctcctaactttggctaggcacaggacacatctttccagctacttctgacactctcgaaaacaagaaacaagatttttttcttcatcaggactggagatttactggggacagggaaatcttcgaggattcagaagacctcctgcttccttagggtcattattcctgatcatcacccttttccagttctcaaccttcatggcatttctgcctcctcttctgtggctgaagtgggactcacaagctctctc

SEQ ID NO: 101754 - DNA, 363 bp, Homo sapiens
caattattggtagctaatctgaatttctttctgatttccttgctttcacagtattcattcatcaactttttgagtaccctccatgtatcaagcagtgtgctgagcccaggagaaaacattttgccagctttgccatacaagccagcagtttatagtatatggaaaagtcatgcaaatagacagaaaattataagagagaaagtagccccacttcccctgagggtggggactctgtgtacatcgtatttcttttcttgttgtagtcttcattacagctcacggacctttacttcatgcgcctcagttgcaccaaagtaaaattagaaatctattaggggacagtgaaatttgaaaatgaggaag

SEQ ID NO: 101755 - DNA, 769 bp, Homo sapiens
ttttttagatggagtcttgctctgttgttgcccaggctggagtgcagtggtgtgaacttggctcacagcaacctccacctcccaggttcaagtgattctcctgcctcagcttctggaggagctgggattacaggtgactgccaccatgcccaattaatttttgtaattttagtagagatggggtttcaccatgttggccagtctggtctcctcacctcatgtgatctgcccgccttggactccaaaagtgctgggattacaggcatgagccaccactccaggccttgaatgtgaatcttgtatgtgaatcagcggaagcgataagaggctcagttgacactatgagatcacaaggttcaaatactaagggatctagaatactctgattccttatctttaacaggagtattgcaatttttttgtcttgtcttttggctgtccattaaaaatggttgagaccccctaaagtataaatttctaagatcaagtccaagcttagactaaaaggatacgatccattgatagtttaccttattctgtgacttggaaatagtattatgaaactgatatcctccactactgaagaaactaatctcacagggattctgaatcacaaacgaattttgctaatttatttaaaagcaaatgatttggttttcataatttcatttagaaattcagagacaatgaaatggattaaattctactgacttgaatgcaattgttttttaaaagagactagcatctttccaagctatcttactcatct

SEQ ID NO: 101756 - DNA, 687 bp, Homo sapiens
ctagggatgctgctgtgtctgaaactggccagtgaaacccacaaatctattcaccagcaccacacctggctagggacgctccgagagccgggctccttgctggtctcctgaggctgaggttcccagagacatgctcagtacaacctggccgtgttccttcatctcccaagtggatgaatgaagctctcctcacaagcatgcacaacggctccacgccaaagcttcccacagaacacagaacctggctataaggctccatcaaacggcaggtttctctctctctccaactcacccactgaaagtttcagagacacgggagagcagaaccctagaacaatgaggcaatcttcaacatcacaactaacaactcctatttattaagcatttgtatgtgtaaaactgtgccatgagttttccattcattcccttgcagaatctccagcctcatttaagaggcactgagatccatggaagtcaaataaccaagaggtaacaacctcaaagttgcaagctcagatatgctgctaacttccttgtctgacactaggcagccccctcctctgtctgtaaccaaagaaattcataaagttcaggcccaaagacgaactagccatcaactaaatctaaggagtaacctattaagtacttttacagaaaccaacagaaataaattctgcttcaaatagc

SEQ ID NO: 101757 - DNA, 101 bp, Homo sapiens
gtggggaagatggccaggaggtccctccaggcagccagaggagtcaaagcaaagctgtaagggacatcacaaaagcaggtcttcaacacagcatggcaagg

SEQ ID NO: 101758 - DNA, 219 bp, Homo sapiens
agaccaagacggaggcaatgtttgaggagatcttgaaaatctgcgagttttccagaactgctgaaagacaccaatcctcagactaggaatctcacaaaataacaaacaggacaaaaagaaaagaaaagaaagtcatggccgggcgcggtggctcacgcctataatcccagcactttgggaggccgaggcgggcagatcacaaggtcaggagatcgagac

SEQ ID NO: 101759 - DNA, 170 bp, Homo sapiens
gggatatatttttatttatctatgtcttcaattttttagtcaatgttttataattttcaataaacacatctttcacctccttggctaaatttactcctaagtattttttatgttattgtaaatgggattgttattttccatttctttttaagatagctcattattaatgt

SEQ ID NO: 101760 - DNA, 217 bp, Homo sapiens
cacccggcggggactggccctggggccgaggcatgggctcagccgccgccctgcagggacgtagccagggacctcttcccagcagagggactcccccactcatccccagaatactgaggggcacgctgggtgccaggctggcagggaccctggggattctgctgtgagctggatggggaaggagttccttcctaaaatgtggagtctggaggccact

SEQ ID NO: 101761 - DNA, 630 bp, Homo sapiens
gtagagacggggtttcaccatgttggtcaggatggtctcgatctcttgacctcgtgatccgcctgcctcggcctcccaaagaattttgtcctgttttatacttgctttatgaagagaagatttctctgacctcatgctaccatagttggaagtttcccctagatctgaagatatattttcaatttataaatatgtgcttttaaagatgtgccttctactttccttcttctctttctgcatatgaatatttatttaagagtataaacatagttttttaaagatcatctacggtttatctactttgtgcatgatccacagtgactccgttcctgatattattgcctagttaggtctcttaactcagacaaaagaattctaacaaaagtgcattacagttaaagacagggagtttaatatgtataaatttatgtgtgtctataatttaagagcaagtaaaatttatttgatttgtgttatctgttatgtcataattcaccttttaactgtcagaaaacagctttttctgcttcacttctacctggaaaagcgttcttgggaaagtgcacttggtgagggtaccttaggaaaatttgatacccaaataaaatgttttttaagcactgtacaaaa

SEQ ID NO: 101762 - DNA, 687 bp, Homo sapiens
gcgggaaatgagctggctctgcacattcggcctcttccagcggctccctgttccccagagctgagatttctttacatcacagtggttcaaggagaaaaacacagccagatccttcctcatctcaacataaattaaacccagaggcagtcagcgccacagtccacactcgtaaccgttacactcacctggaaataaaagtatttttgtgcggggactgcaaggactaagcccggccgcactccgagtttctcctcctcacagttaattgttttcttggcactctctcccttctcacctgtgactacctgagtgtccccagaggcaaggaactatgtgagccactccagtgttcccagccccaaggccaggcacagtggacatttattgctgaatgaatgaatcaagagagaggatcagaaagctgcagaggatgatagatctgcaaaattctccctgggtgaggcccaggctcagcttccagaacagctccatctgtctcccactcactgagattgaactaatgtcccacagttggacagacctgaaattgagctctgtgattttggatacctgcccctctgctggagattctgcatgtctgaggtaccagccattgccagaaactgggctatgttctctcctttcattgtgccatttcattctcaccccaaaatgaaaacacacaaa

SEQ ID NO: 101763 - DNA, 855 bp, Homo sapiens
agcctcagggagctctagtggagagacaagattcgtgcatgaaataattacgactgttgtagaaaaaagaaaagcctgtaggtctcccttcctccctccttctctctgtctacctcagcatttctggggttcactctgctctgggtactgtgtaaaggactccacagccatcaacttcccttcatccttgccgtgtctttgaaagagctgagatttctttacatcacagtggttcaaggagaaaaacacagccagatccttcctcatctcaacataaattaaacccagaggcagtcagcgccacagtccacactcgtaaccgttacactcacctggaaataaaagtatttttgtgcggggactgcaaggactaagcccggccgcactccgagtttctcctcctcacagataggggctgaggctcagagagggcaagtgacctgcccaaagtcacacagccgtgactcattgctcaggtgaggaaactgaggctcagagagggtccgtggcatgtccaaggttactctgctgttaattgttttcttggcactctctcccttctcacctgtgactacctgagtgtccccagaggcaaggaactatgtgagccactccagtgttcccagccccaaggccaggcacagtggacatttattgctgaatgaatgaatcaagagagaggatcagaaagctgcagaggatgatagatctgcaaaattctccctgggtgaggcccaggctcagcttccagaacagctccatctgtctcccactcactgagattgaactaatgtcccacagttggacagacctgaaattgagctctgtgattttgggtaagtcacttaacttctg

SEQ ID NO: 101764 - DNA, 606 bp, Homo sapiens
gcgggaaatgagctggctctgcacattcggcctcttccagcggctccctgttccccagagctgagatttctttacatcacagtggttcaaggagaaaaacacagccagatccttcctcatctcaacataaattaaacccagaggcagtcagcgccacagtccacactcgtaaccgttacactcacctggaaataaaagtatttttgtgcggggactgcaaggactaagcccggccgcactccgagtttctcctcctcacagtgactcattgctcaggtgaggaaactgaggctcagagagggtccgtggcatgtccaaggttactctgctgtgtccccagaggcaaggaactatgtgagccactccagtgttcccagccccaaggccaggcacagtggacatttattgctgaatgaatgaatcaagagagaggatcagaaagctgcagaggatgatagatctgcaaaattctccctgggtgaggcccaggctcagcttccagaacagctccatctgtctcccactcactgagattgaactaatgtcccacagttggacagacctgaaattgagctctgtgattttgggtaagtcacttaacttctg

SEQ ID NO: 101765 - DNA, 476 bp, Homo sapiens
aggcctcagtcccctccgggaggcaggtgtctccagcgtggagatggcctcttcacagacgcctgcaccctggcctggttggtcctggtcactggtcgtatcccttgctcctccacatatggtgttaacggtttatcctgattttttttttttaaggagtctcgctttgtctcccaggctggagtacggtggcgcagtctaatctcactgtagcgtccgcctcctgggttcaagtgattctcctgcctcagcctgctgagtagctggcattacaggtgctcaccatcatgtctggctaatttttttgtatttttaaaagagatgaggtttcaccatgttggccaggttggtcttgaactcctgacctcaagcagtccacccgccttggcctcccaaagtgtggggattacgggtgtcagccaccacacctggcctatcctaatttctggatagctttattgcagttgaaaatcagg

SEQ ID NO: 101766 - DNA, 335 bp, Homo sapiens
acacaaatgcagaccccgtgagggtgggcagtgctagccccatttatgctactatttgctggattgagtctgttacgcaccttctctatgcctcagctttctcatctgtaatatgtggggtagattatatgaatctatctttaaaatactaagatttgaatgctctatagaaatactgtgagtttaaatttgacttacaggaaaaggcatgatgagcttgtgattcttgtaaaaatgaatggaagagaaaaacccagttgtcattctgtttttatatgttgcttcaatacagctttattcttccagaataaagaaaaatcatctagagttccaga

SEQ ID NO: 101767 - DNA, 492 bp, Homo sapiens
gagctctgcttactgtcatgatggattatatgcacgcagcagaagaggaaagaagtaccgctgacaggaagacctagggtcttttttagccagaggtctctatagacatgccatcaatagtaatggcaaccgcagtgtatcatcgtgacgatgtgcttaatcagggctcaggtgttgaggatgtagacttgggagagccccttgttggtgtgcttaaggcatcctggtttcagtcaggtcaggtcccctcacctaatactggcctgaggcccaagaccaagatacaaggactgaggctgactcttgctctgtcgcccaggctggagtgcagtggtgtgatctcagctcactccaacctcgacctccctggttcaagcaattcccctgcctcagccgcctgagtagctgggattacaggagcatgccaccatgcctggctaattatttatttatttatttatttatttatttttagtagagacggggtttcac

SEQ ID NO: 101768 - DNA, 425 bp, Homo sapiens
gaggtgggaaggacatgaatgtcatggctccaggaacctctgctctcaactggttccataacaggcagcaacagatagatctggcgcaactcacttcaaatctggagttggatcttaggcttttgaaggagtcagtggggaggcagcttttaatatgtagtctcatgatatcatctaagctgacgggatctatgatttctaagaagggtttgccagtgggtttgaggaggacctgggcttttttgagccttccttcttgatatgtcgtgcaagatgccttcagggtaccctctctttctggcctttctattttgtttcccgtcatttcctccctccttttcatcctctctccactcccgggagtggagagagaaaggaaggaaggaaggaagaaaggaagacagacaggaaggaagaaagaaagg

SEQ ID NO: 101769 - DNA, 145 bp, Homo sapiens
cactcaaaagctgaaagcactcattacaagcagacctgcagtggaaaagtgttcaaggaaatcctttaagaacgaggaaaatgatgccagatataaaaacataaatctacacaaagaagaacaagcagaaatggtaactgcacag

SEQ ID NO: 101770 - DNA, 222 bp, Homo sapiens
tcaggtgtctttctgcatttctgaagcggtccctgtaagactaaaatttgtattcctcaataattgaattgaacttggtgaggacacaatctaaatattatgtgctgattaaatagagatcacatttaggggtgtggaataagcatgtaatacaaaattgtttatacaacttaattaaaattttttaaaaagtataaattaaatatgagaaattatctccat

SEQ ID NO: 101771 - DNA, 179 bp, Homo sapiens
ctatagatcagaacttaaactatggggggtggcatttgtgttaggttgttttattataaagaaaagatctgatttttaaaatacagcaaaatgtgaatatatataatattaatgtcatgtatctgtttctatttccttggattatgttattcaaaattaattttgtatagctagaggcc

SEQ ID NO: 101772 - DNA, 397 bp, Homo sapiens
  misc_feature (32)..(32): n is a, c, g, or t
  misc_feature (37)..(37): n is a, c, g, or t
  misc_feature (39)..(39): n is a, c, g, or t
  misc_feature (45)..(46): n is a, c, g, or t
  misc_feature (70)..(71): n is a, c, g, or t
ttctagcataagcatgattactatcaaatganatagnantaggtnngaatgagggtagtgagcttgcttnngagatctgtagattctgatgtacctagaactaagggatataatgacaaaacaggaaaaatgctagtctggaactgtggatgtcgggctaccaatatatttggggaccataagcatgtaggaagaagcagttttttctgttttttttactgccagggtaatagtagaagattcagaagtgttgggaatgaagttgttcctacccaagaggtctccctgcccagtggatgggctggttaccacagggggcccttgcccggcccggccccctcagctcctccggagacctggctgagagccgtgcagatggcctggctcccacaggccc

SEQ ID NO: 101773 - DNA, 246 bp, Homo sapiens
gactctagaggttcccggtccgctcggaccaacctggagctctgtgcctcctacgtttacctgtccatgtcttactgctttgaccgtgatgatgtggctttgaagaactttgccaaatactttcttcaccaatctcatgaggagagggagcatgctgagaaactgatgaagctgcagaaccaacgaggtggccgaatcttccttcaggatatcaaaaaaccagactgtgatgactgggagagcggg

SEQ ID NO: 101774 - DNA, 427 bp, Homo sapiens
agaagaaaaaggaaagggactctctcttacttggaataatttcttttttccctccctccgtggcttcttcccttcctcccttgactatgtagtggcaaagagctaagtaaaattgagttcaaaatctttactctagcatcttactggctactttacttgggcaagttacttaatgttcctgatcctcagaaactctctatatagaattagaataacaagacttacctcatatagctgttactaggatttaaaatgagagcatatatgtaaactgcttggcctagagaggcactcaagcagtgtttgtccccttcccccattctaactggatctcctccctctcatttcacctcgattcaatcagtttttaaagtgcacatttctcagcactataggaaagggaaaaaaatttaaaaataaagtggac

SEQ ID NO: 101775 - DNA, 368 bp, Homo sapiens
atttatgaatacaacattgcataattaagtcaagctgattaacctgttcaccactggaaacaattgcaaataattatcattttttctggtgaaaacatctgaaatttactcagtgattttgaaatgtgcagtactttttgttgttgttgtagaaatgaggtctcactatgttggccaggctggtttcaaactcctaagctcaagtgatcctgttagatcagccatggcattagattctcaaaggagctcgaatcctgctgtgaaccgcacgtgcaagagatctaggttgcatgctccttatgagaatctaatgataaatgtaatgtacttgaatcatcctgaaaccatccccctgaaccccccccgca

SEQ ID NO: 101776 - DNA, 773 bp, Homo sapiens
atcagtagtcatttcctgttcacccctaacccagcccctaagcaaccactaatctacttcccatctctatagatctgcctattctgaatattttatataaatgaaattacacgatatgtggtcttttgtgactggattctttcacgcaccacaattctttgaggctcatccattttctatcctgtgtcagtgtttcattcatttttattgctgaataatacctcattgtatggatagaccacacttaatacgaacatttgaatattgatcaatataagagatttttgtttctttttcttttcttttttttttcagaaattgagtttcactatatagcccaggctagtctccaactcctgggctcagatgagcctcctgcctcagcctcccaagtatttgggactagaggtgggtgccactgctcctagctataagtttttatgccaatatatgttttatttctcttaggtatacatctaggccatatagtaactctgtgtttaacattgttagacattgtcgaatactgacagttttccaaagtgcacccttgcggcacccttttacatcctcaccagcgctatgtaaacaggtttcgaatttttccacattcttgtgaacacctgtcaatttcatcttttttattatagccactctagtgggtgtcaagtggtatctcattgtggttttgatttgaatttccctaatgcactttgtccatttgtcttctttgaaaaaaatgtctatttggatcttttgcccatcttaaattg

SEQ ID NO: 101777 - DNA, 241 bp, Homo sapiens
ttggctcactgcaacctccacctccctggttcaagcgattctcctgcctcagcctcccaaagtgctgggattacaggcatgcaacaccacacccagcctgaaacccagatttttaatatgaaatcaaagtcttcagaccttgtaggtgtcataaaaagcacgctgaggaccactagtttgcaactgccaatctaaaatatcatagacattatatcacttcaaccacgaaaaaaaaagtatg

SEQ ID NO: 101778 - DNA, 442 bp, Homo sapiens
gataaatattgagcacaactcctggtttatggttaaacgtatgtttactttgcaagaaattgccaaactgtcttccaaagcggctctaccgttttgcatttccacaagcaactagcttttggtttcattgatttttctctattgattttgattttcaattgtagtgatttctgctctaatttttaaaagtttattttcctctcctcatcttggatttaatattctcttctttttctagtttcctaagacagaagcttagattattgactttagatctttctttatctgggcgtggtggctcaagcctgcaatcccagcactttgggaggctgaggggggcagaggccaggagttcaagaccagcctggccaacatggtgaaactttgtctctactaaaaatagaaagattagctggcgtggtgatgcgcgcctgtaatccca

SEQ ID NO: 101779 - DNA, 166 bp, Homo sapiens
gtgccaccccccacccctgccgtctccttactccacttaggcagtctcagcaagacatcttcttttattcttctttatttatttatttttgaggcacagtctcattttgtcacccaggctggagtgcggtggcacaatcttggctcactgcaaactctacatctcg

SEQ ID NO: 101780 - DNA, 156 bp, Homo sapiens
taatatattgtcgtctgattggtattcctccaggcacccttttctaaatcacatttttagacctactttgtctgcctgcatgtggctaattctcttccatgcatttctacccagggtttggttatttttttttccttgggttcttacacccaagga

SEQ ID NO: 101781 - DNA, 616 bp, Homo sapiens
ttttttttgcagacaagctgtcacactgtgaattgtcctgtgattctaggtctcctccaagggtcaaaggagactgaggactgcttctagagttttccactaacaggccacgtaagtgtcccgaagattcatggcttctttctacctcccagatcttgaatctgcaccagtaacctctttcctgcagtagcctagatttctggatcacctgaccatcttatctccctgcacgcacacatttataagtcagagctgtcctgcctgggccagtatctgtagcactaaccagttctttcaccaattgtgcaccaaagctcacccatggattcttgatagcaccttttctattctgcatttttcccccacaaaccctctttcctgtgaagacagtatgcccaaggtctccctgcaggtgcctaaatccaggccatgctggaaatcagatgtccatgagttcgaagcagagtttttggatgtggttattgtaaatataagtgcaaaacagaaatgagagacttagtcctccaactggaaaataaaggaagagtattttctctcctcccttttctaaaaacctttcattagaattttttttttttttgagatggagtctcac

SEQ ID NO: 101782 - DNA, 561 bp, Homo sapiens
attatgtgggtattttcccttaaaatattcaaagggatttacatatgggattagctaatgagcctagccaagaccttccctggaggacaggctggtcattgcggaggtcccttctgtgcttcagtgggttcatatcctctagtccgtatgattttcctacgctaatatgtcaagggcaggagaggcagctctgttctcctagcctttgttgacttgtctgcaaagcaggaatctgcccatttgtttccaaggagcaaatgagctcatgagaatgaaagatgttaacttcatgcattctgtgccatctgagcatttcggtattatatgactggtgacccttggcccgtattataaatgcttcctatcctgggagacctcatggatgagtctgagaggaaatttggcaccaaaatcactctcactctggtttccagtagactatagaggcagagaggcatttgagaggctcctgagcaaagtgtccagtgtagcaggagcacttcattaatatttattgagttataattaaataaaaattaatttctgatttctcagtttgga

SEQ ID NO: 101783 - DNA, 362 bp, Homo sapiens
ttattctacaagaatgtatcttagtaagaacttttaaccaatgctattttttgctgatgtaaatttttttaacgaatagaaaatcatttcttttttcagtactgcccaggtcggcatagttctctttcccttatatcttaaagtgcatacacacatgcatgcctgcacacatatatctttttttctcatggctgagtttaaggaagtaaatgaatgcattctacttaactcttcacaatgtagttgggggtggtggctcatgcctgtaatcccagtgacttggaaggcaaaggtgggaggattgcttgaggccaagaattcaagaccagcctgggcaacacagcaagactttctctacagaa

SEQ ID NO: 101784 - DNA, 248 bp, Homo sapiens
atccttccctcctcacgctttgaaattctgtcatcctttgcttcccggccatcccactctcctagttttccatctccctagctgacaactcctttcagtctcccttgcacggttctcatctcttaacgttacaagtctctgagagctcaatcctcggaactcgtctcctatctgcttactcccttacaaatcggagtcaatctcacatcttccaataccagttagtcatatgcttacgaaaaccaaat

SEQ ID NO: 101785 - DNA, 421 bp, Homo sapiens
aattttagcagtattttatagtttcctgtgtataatttttttatttcttttgttaaatttctaaatgctttattctttttgatgctattgtgaatgaattcttttcttaattttattttcagattgttcattgcataaaaatacaattggtgagccaggtgccgtggctcatacctgtaatcccagcactttgggaggctgaggtgggtggatcaattgagctcagcagttcgagaccagcctgggcaacatggcaaaaccccatctctacagaaaatacaaaaattagccaggtgtgtggcatgcacctgtggtcccaactacttgggaggctgaggtgggaggatcgcttgagcctgggaggcaaagtttgcagtgagccaagatcgtgcctctgcactccagcctcctgtctcaaaaa

SEQ ID NO: 101786 - DNA, 1456 bp, Homo sapiens
tcttttccaaataattgctttgggaaattgtggggtttctgactgtttacattttaacaaaagagagaggacttgagtcccaactttcagagtttgttccggtccagacaaaagccattccttagtctgtttgcaaaatctgttccaaagtaatttagaatagaaaatatgaaagccgaccttcccagccatgacaaatcagaagatgaattgtaaaataaatctctgaagcagtgtttatatttctgaatcagagagcaaagtcactgaaaaggcaatctgttacaaactgcaggatgcacactagaacagctcaaggaaaagaggagagcaggaggagtgtctcttctgtgttagggccgacttgagatcctgggtattgaaactgatatttctagattcttgtccttccctgagagggaagtttggtcaacagaaactgatatttctggacaatattcctatcaggaaacttgtacctcaaaatatgcccccttgtgcagatatttttgtatttatttgtcaaaaataaattgtggaggaaattaataatccaattaataatcactttgaatgagccacccaatatacatttacctttttgggaaacggtaaatcaagaaaatattgcaggaagacaccccaactctctgagcagtttgatggacgggtgtcggtggtgtggattttcttggacactaatgatgtgatgtttggttgtcccaagggacactgggcctggtcacttgctggggctactcattttgttagtagtttgttaagttacttggtacgaatccatccgtttctctctgacctatattgacaagtggaattattaaaggtctcagccttgccagagattctgtttcccttaaaggcagtcagtggtccattgcgatggagtcagtgactagaaaagagggactggaaacgtgaatggcttcactgagaagagtgggtggggggagggtacctgtttgctttgctaagggcgtgtcttgaaggttttaatgagtgaaatgagcaggtttcctaatatttctcaattccagacacaccagcatttccgtttccaggtacttaaatttcattttctcatttgttttattgatcgtttccaaatgaatccagagagacgatgttacctgtgtatccaagaatactaacgcagtaataattggcaaaaagagattacctactccatcagatttgagtggctcccagatttctctccagtcatgattgttagcagtaaacttgattttaataaccgtagatgagatggagaggcagggaggaaggcagaaaaaaaaaaaaagttgtgatggttagccaatagtgatccgtctccccactgattctttatttagttggatttaaaaacattatgatgtatgtgggccaccattcggtgcatctaattaaaatggtcacatccagtgtcatttcttct

SEQ ID NO: 101787 - DNA, 511 bp, Homo sapiens
caagaatttcccccaaaagaatcctttaaccaaaaagttgtggtttcttgccttgctaactgtaccatagttattcctgcaggtgaatatataggctttatctgggttatttatttatttaatttttttttgagacagggtttcgctctgttgcccaacctggagtgcagcttccgcctcctaagctcaagccatcctcttacctcagcatcctgagtagcttggactataggcacgtgccactatgcctgactaatttttgtatttttttgtagagatggggattcaccatgttgcccatgctggtctggaactcatgagctcaggtgatccacccacctcagcctctcaaagtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatct

SEQ ID NO: 101788 - DNA, 408 bp, Homo sapiens
gagctcggtacccccgaatagctactaaatgagcattttgggaggcttaggtggacagatcaccaggtcaggagtttgagaccagtctggccgacacagtgaaaccccgcctctacttaaaataccaaatataagccgggtgtggtggcacacacctgtagccccagctaattgggaggctgaggtaggagactctcatgagcccagggggcagaggttgcagtgacctgagatcgtgccattgcactccgtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatct

SEQ ID NO: 101789 - DNA, 358 bp, Homo sapiens
attgcactccagcctgggcaataagagcaaaactcccatctcgaaaaagtaaagaaaagaaagaaaagcatcaaattcatgtcaggcttttgagctgaactccagcaggaatgttaaagaagtgtagatgttcagaaatttttctgtgtaactacaggtttttgctgactcacgctttttagaactagttacgaagtacagcattctagaagatgaattttgtgtttttcttttctgtctttccattgccccatgtcccaccttttccttttgtggtattcttttgttcccaactggtcttagtcttctctcctcctgtgcctaagtgatccttaatccagcagtgggtttgcattcc

SEQ ID NO: 101790 - DNA, 831 bp, Homo sapiens
cccaattaggttcaattagggttgaggggaccagctggatatagtcagggcgtgaggccagttcagcaaaagggtatcctaggggaaatttaaaaacagagttttccctatgccaaaaaggaaagagactcattcccttcttcctttcttggagaatttccttgagaaaatttgtgtttgtaattatatcttctgtccctttgataggtatgtaaatcttttgtgtgtgcgccattctttcatacaatcccaccgggccctggacactctcaccaacatcccatacttccttctccccttctgtacatttcatggaccccagggtaggaggggctgggtgagggttcgggatccccctcctgccatcctaactaagcatctggggtaccagccctgctgccaagtgatcttgtccctagccctctctccccaggctggcatgagtgtgtgtttgtgccaagcttctatttcatattgcaaatataaatcaaggaaaacaatttaagttaaaatgaaagaaaaagaaggctgggcgccatggctcacacccgtaattccagcactttgggaagccgaggcgggagttcaggaattggagaccagcctgcacaacatggtgaaaccccatctctacaaaaaaaaaatgcaaaaattagtcgggcttggtggtgtgtgcctgcagccccagctactcaggagcctaaggtgggaggctggcttgagtccaggaggcagaagttgctgtgagccgagatgacgccactgtactctaacctggatgacagagtgaaactctctctcaaaaaaaaaaaaaaaaaaaagaggccgggc

SEQ ID NO: 101791 - DNA, 154 bp, Homo sapiens
gacctgccctgcctgtaaggattctcggatggcactgatgtgatatgatttacaaataaacacacctgctgtgattcttagtaacagtgagaataagagttctcactcagattggaaaggaggccccgggctcctcagattcacccacagctca

SEQ ID NO: 101792 - DNA, 341 bp, Homo sapiens
catcagggctgcaggtcagctcttccctgtcttcagtaaaggatggacgcgaggaccagggtccccagtgtcagtggcgggtcagggatgccaaagtgctgagcagaagttggccagcccttgccagaggctctggagctgggccctgacacacgatgccgtgtgtagtgacatgcaattccatgtagtgacgtgattccgtgtagtaaggcgatgccgtgtgtggtgacgtgcagttccgtgtagtgacgtgatgccgtgtgtggtgacatgcagttccgtgtagtgacgtgatgccgggtagtgacgtgatgccgtgtagtgacgcaatgccgtgtagt

SEQ ID NO: 101793 - DNA, 103 bp, Homo sapiens
cttctcatggaatagtgggcatgttgttagaagggtgccagtacccagtaacattaaaagaaaacaattgtgagagaaatctaggaagtataaaataacattt

SEQ ID NO: 101794 - DNA, 204 bp, Homo sapiens
aagctgaatgtaaccctttgttctcaccctttcttcagatgtgctcatgttgttcacattaaccagacaacagtctgagcatgagtctcttaatgaatttctgtagggagacaggtataatttatacgttttagtcttcttttcttttttggagatggagtctcgctctgttgcccaggctggagcgcagtggcgcgatctcgg

SEQ ID NO: 101795 - DNA, 307 bp, Homo sapiens
attcaactctcatctcacctattctgtactctttaacctaacaggatctccaatgctcatattctcctcacctatgaagacttttggcttcattcctgatatggtttggctgtgtccctacccaaatctcatcttgagttgtagctcccacaattcccacatgtcatgggagggtacccgttgggacgcaactgaatcatgggagcaggtctttcccatccttattcttgatagtgaataagcctcatgagagctgatggtttcttaagggggagtttccctccacaagctcttgctttgcccgctg

SEQ ID NO: 101796 - DNA, 461 bp, Homo sapiens
aaaaaaagaagaaattacaaatgatctgatcttgaatgccaaaaatctaacctttgatgttggcttttcggaagttaaataatgaaccaaagtttctttttttccttttttcttaaaggactacttcataaagcctatcttactttataataaaaggaggaaaacataaataaaagacactcaaatatttatacagttattcaaaggattaaatgtatttggtaaggtcttaaggttgtttaatattttccccttcttttgaatctttgtttttagctctggtacattgaagattttctttttcctgtggttttgtttatagaaattaacaaattcccttgtgatccttaagaagttactttagaaatatacaaatatacatgaatgagagaaaggggatatgaaatagatgagataaggaaatattgtcataataactacactctttatattacactact

SEQ ID NO: 101797 - DNA, 655 bp, Homo sapiens
agcgcctagaacagtgcctggcacataatgtggatgtcagtcaatgttggatttacttgtgcttgtttatttaaaaactatttggggttagattgtcaggaaccctgctacatgttgtgtaaggcttctagtgtgtacgtgtgtgtatttcatataatacatttatgtgtatgagcagttggaattgatcactaaaatatttcttaaaggtaatataagtacaatttggtatgttgagtatcatgaatgaatcaatgcaaagattcaagtatctttgggtagaatcatgtcctttgaaatgtcagtgtacagtaaaaaggtctgacatcataactagattataaatcctatactcttgtactccaaagtcagtatagttggactggcttgtatgtcctgtttgacaaaatataaattttactttcctgtggcaattcccaaactgggctgaccacttggacttttaagaaaatgtaagcactcttgggcattgacccaacgattttcattcactagatcctggggtggggcctaggaatctgtgttttttaataatttcctttctgtaggtgtttacatatagtcagtttctctgctacccacctttcatgatatactttgaaatttggtgacaatcaccttggaccttttgggt

SEQ ID NO: 101798 - DNA, 787 bp, Homo sapiens
ctcggctcctccgagcgcctcccagctcacggcgccccccgaacccggctccaagggactcggtattccccagcgccggctccgggcagtcccggaagggctcaagggctgggcgactggctgatcgagaccgtccgggtcctggctctcgggtcacttgcagaggcctgagcagagcgttaatgagaatgatccagaagggaggagaagctaatggtgcagtggagagcagagtccctgagcaggtgagcagggatgggggcccatgcccatgtcggaagcgggcgccacactgcttcatgatggaaggcagaacgcctgggccagggtgcaggcaggtgtcacagagaatgtccttcatgaccacatcctagttcccagaacctgcgaatatgctactttacatggcaaaagggagtttgcaaatgtgattaagaattaagctaaagaccttcatacagggagattatcctggattctccagggggctggtgtcatcacaaggatctttaaaagtagaagtaaggaggagacgtgaccaaggaagaagggtcagagagacgcaatgcttccgaggaactctgaggatggaggaagggaccatcctccaaggaatgtgggtggcccctgaatgaagaggcaggagaaggcacacagccctgcctgccaacaccttgatcttagcccagtgaatcctgacagacttctaacccgtggaactgcaagacaataatcgtgtgtttgaagccaccaagagtgtggtcgttggttttggcagccatagaaa

SEQ ID NO: 101799 - DNA, 271 bp, Homo sapiens
agctttcttctcaaccgacatctggaagccattcagtgctgcatacacttcctgcaggctgcccctctgttctctcgcccttctcatctcacgtgattgatcacctgacaagctacctggatttcctagtgccccagagttgccctcaatcaacacacaacacgttcccatgtggaatcttcaccaagtgttcatttcttccattacaggaaatagtattctctccctgtccccaaaactttgcagtaaagacccctgacaatctagttca

SEQ ID NO: 101800 - DNA, 473 bp, Homo sapiens
tctcccagtgagctctatagctgcagagtaaataatactgttaataatagcagtacttataactgacagattgcttataaacaatgagctgccaaggtaggaagcaatcattaatggctaattgggaaagacttcctcgggtttgtgtgttcacctgataatgtacatttcctcgactcttttgagtttgtgttccctgtatttttctgcagggcatgaactgtgcatcaattccctttgtattcccaacaatgaatgagtgagtgaacaaatgaatgaatgaatccatttgttgtttcttttattccatagcctgcttcattgggtatgcaaacttcctcttttaatgttgacattgaaatgccatctgtaccaagactttttagatgccattatgaaagtgactccctgctgtccacgttttatggtgccctgtgtctattaaacttatgtctataaatacctaaaaaaaa

SEQ ID NO: 101801 - DNA, 266 bp, Homo sapiens
gctggctctggctggagatggcaacttccaagcccttctccccgtcatattcaggccaccatccctaatccctccccatatgctttcctgacttgacctcagaatccttcacaataccgactccaagaactgctaccactcagcaggagttgaaaagagatataaagcttatttgcattggtgttccaccctaccagctctttgtgggggaaaaaccctgatctgtaacatctgcagatttttaaaatataaatattcctaccacg

SEQ ID NO: 101802 - DNA, 900 bp, Homo sapiens
gtctttgtgctattgccctttctgctttgggcaccttgacctcaggtctttgtgccgttgccctctctgctttgggcaccttgacctcaggtctttgtgctgttgccctctgtgctttgggcactcttcctcagacctgtgcatcacattccctctcttcagctctctgctcaaatgtcacctccttcctgacatcttccctgaccatcctagccaaaatacccccaccccgtccctctctgtccctcgatcctgccttacttttcttcatcacactcagcattgccacctggaataacaatgatagactttttttgtttgttttttatctgtgctcccactagctccatgaaggcagagatcttgtttggctcgctgcacatccccagcacccaggacagactctggcacatataggtgcttaataagtgtcagctgagtatatgagtgacctccctgaacctcaggtcccttatctgcaaagtaatagatgccttgctggattatacttaaacatgcctcatcattagatggagcaatgaaaatttcagcacaatgtctggtacataataggtgctcaataaatgctcatcatgatgattttaaaaggtgtcatgctgaggcttgaggtgccattttcatcagaagtttgcctgataagatttaagttggctgggtgtggtggctcatgcctgtaatccaagcactttgggaggctgaggctggaggattatgaggtcaagagatcaagaccagcctggccaatatggtgaaacactgtctctactaaaaatacaaaaagttagccaggcgtgatggtgcttgcctgtagtcccagctacttgggaggctgaggcagaagaatcgcttgaacccgggaggtggaggttgcagtgagct

SEQ ID NO: 101803 - DNA, 429 bp, Homo sapiens
tctcattctggtcaagatggagcagccccactccttccaggtcctcttccttaagactaaaaatccttgaccgtgacacaaaaacgtacataggaagccaagatggaaagaagatggcacactgcatagggacttcggcacttgagaggcaagttcctgggtttccttattgtctcccatatatgcccaataaggtgcttcaaaagccttcaacctggcaccgatagacaaataaaaaaaaaatagctccaagaaaaacctgttctttcagccaaaagaccaggaaaagggtaggctaacaactgaaaatctttctggcaataccctccctattccaggcaacagggagggtactgccaaaaagaaaatggaaaaactgcagcaatggaaaaactgcagcaccaccccactgaggtttcagcaggccca

SEQ ID NO: 101804 - DNA, 263 bp, Homo sapiens
gcctgactctaatgtcctctgcagtccacttccctagccctgtccctttccatttaaaatgaatatgtccagcctgggcaacataaggagaccctgtctctacaaaaaaaatttttttaattagccaggcatggtgtgcacctgtaatcccagttactcgggaggttgaggcaggagaattgcttgaacctgggtggcggaggttgcagtgagccaagatcatgctactgcactccagcctgggcgacgagggagaatctctc

SEQ ID NO: 101805 - DNA, 691 bp, Homo sapiens
tgcagagctctggtgggcagagaggaagcgcggatgagcgaggtgggaggggcccggggtccacgtggagcacgccccttcccagcaaggggggcgttcattgcgcagagctccaccaggcaggcgcccagggatggccaccagtccccgagtttccaatggcctctgccttcctcagacacctccctcgcttcagcggtttcagtaaccataccggggctgcttcctgcccatgtttttgcccatgctttttacagcatttaaaaatgtatatgtttgtttcatcataatttacctttgtggcttagaaatcaaatcatggaaagcaactgtctccaactccaccctcgccgaccgcagcctccgcctcagagccagatcctcttcctcttccttagtaggcatcttctccgactcggcttctaagtccggctctttttgtgtgggttccagggccctgccgtgggggcaaagaggatggagttgcttacccaccatttcctcttggctggcgggctgcttattgcgaaggtgagacagaactgtggggcgggaagcaggagaggaatcgcccgcacctggaatttctcttttagtttatttgcttcctggttccattttctgtaaactacagccaatcattctgttcagagtggagcgtggagtggggtaagtggtggtgagagtgcat

SEQ ID NO: 101806 - DNA, 409 bp, Homo sapiens
tccgcagttagacgtgggccaggtctccacggagcatgcgtgcttggctgtccctgctcggcccaggggcaaggcctgctctgctgcagccctctctggcccccttttcccttcctcccatccttccccaccaggaaccttcccttcccccacaggcctccactccacactcgaggggagcacctttgctcacaccctctgtagctgtctgcggagtggagcaggaggaaagggaccgccacgtgctcactgtcgcctgttcgaggagatgcgtccactctggcctttcccctgcactgggcatgtcactgtcacctaaccactgcccctcttgtggagggacttgtgaggtccactgtcccggggagcagggtctgagagcagagctgggcaccccacctctctcatc

SEQ ID NO: 101807 - DNA, 411 bp, Homo sapiens
agggaaggaggtaaaaatggcttaaggggggaataaaatccttcaagggcccacagacaactataacagccccttgtcttggcaagaggctgatccttggtgacttttttcacccagttgaaagtcctaggactgcagataagacacaaaccctgcaccctcacttcctctactcctgtgcagattctagaattccctggtagactgcagaactaccctcatcctgtgagtagtacctggtgggagagaggaatgtcccctaggttcagccaacagcagcacatctatggagaaacgagaagggcgaccagacgtctgccatgttcaccatgtggacgtgacacacaggcagagcctgctccactctgcagctctgggtgtcccagccctagtcagtcccatctgaagccc

SEQ ID NO: 101808 - DNA, 382 bp, Homo sapiens
cctcgttaactcccaagatcagtgtctccatggccacagaatccccttctggagtcagacacatggcagcccaggatgaagaccatgctttccagagtccctatagacaggtgccaaaacactgcctacgagagctaagctgaagtaaccaactccaggttgagtccctaaaaggaaaggggccacccttccctcttcctttcctcctagctagaagaagaaggaaataggaagccatcagtgatgatatgaagaaccggtgtaccacagcaagctgaagggattcaggagttgccataccaggcctggtgtatttacaccaagctgttacatcaaagaaagaaagttttatcttgtttaaaccatggttactctagatcag

SEQ ID NO: 101809 - DNA, 374 bp, Homo sapiens
attatgggagaagagccacacaggatcagatagaacatctacgtgaggttctatcatccacacccccaaataagaaatgttttaaagcctgtctaggatcagagtcaaatgaacatgagagctgaaagcaaattttgaaatcataccttcattttatatatgagaagacctttaacatgaatgatgaggaagtgaagtgacttgcctaacatcccatagctagtttgggatagagctggggctggaactcaggtctccggatcctaggccagccaatttctccctgcatttacctcaatttcgaatcttaaagtcaccgggaccagcacattcaggataaaatcttggtgcccattcacctttttacaagtctg

SEQ ID NO: 101810 - DNA, 855 bp, Homo sapiens
tttgggtgctaattcggcttggatgaggtcatgagggtggagcccccaggatgggattattgttcttataagaaaagaagaggctgggagcagtggctcacacctgtaatcccagcactttgggaagccgaggtgggcagatgtcgaggtccggagattgagaccatcctggctaccacagtgaaaccccgtctctactaaaaatacaaaaaattagccgggtgtggtggcgcacgcctgtagaaccggctactcaggaggccgaggcaggagaatcgcttgaacccaggaggcggaggttgtagtgagccaagatcgagattgcatcactgcattccagcctgggagacacagcgatattccgtctccaaaaaaaaaaaaaaaaaaaaaagaaaaaaagaaaagaaaagaaaaaaaagggggggggcctaaaaaaaatcacccaggggggggcacaaacagcaagcggagtaccccaaaggtgtgtatttgccaacacagggggggccccaaaaagggagagcgcagtaatagagaagccgggaggaagtggggagacaagaaaaaacaacaggcgagagcgtgggcgaacacacggccgacacacgggcgacacactagcggcagcagagcgaccccccaataaccacgggggcggggcgacaacaaaattagggaaaacacccatccccacaagacaacttataaacgccccagcgggcggaaccacaagtaacaagcacacacaacagggcaacagaggtggttcaacaaacacacgcagagataaatagagagcagcagacgaagaatcgcgcaccgcagagcgcagcaagccagtccaagcgacacact

SEQ ID NO: 101811 - DNA, 759 bp, Homo sapiens
  misc_feature (151)..(151): n is a, c, g, or t
  misc_feature (153)..(153): n is a, c, g, or t
  misc_feature (157)..(158): n is a, c, g, or t
aaacaggtcctttaggggatcggataaagggcacagtattaataacttctgaaccccgcccagcaacacagactaggtttattcatgttccagtgggagctgccaaggcgaaagggccgtgtctaccaggttgcacacagctgataagttncnggannattccagcttcatccatgtcccttcaaaggacatgaactcattctttgttatagagatgccgggtcttgctatgttgcctagactggacttaaaccccgggcctcaagcaatcctcatgtcttgaactcccaaaatgctgggattactgtcatgagccaccattccttgccaaaatttaagttatacatacaggagactcttacctgcattgtatacaacactagaccactacttgtattaaaacaaatatatctacatagatagatattttccacacatatgcacaaatgtgtgcatatctaagtcaagaaatgtgtgacagtgtatattgggtctatggccaatgaactatcagccatgttttgtaataaaacaactagttggagaattaatatcttccaaaagcaagaatatacatttatgttgtttgatttttcccttcagaacttcatgactcaagaaaaacatcaactatgtgtgactaaaataaattcataagaaatagtctaaaaggggatagatgctgttgtttatgtacttaatgctattctaattttaaaaaatgtggtctgcattccattaaaccaattttataaacca

SEQ ID NO: 101812 - DNA, 471 bp, Homo sapiens
ttcctactccccatccccacactcagcttgagtgaccacagccacacccacttcttctactactactcaggggctgatgctcagcttccaaactggggtgtcgcaactagtcctcttccccaatgcctacactgtccatggaaatacctcaaattcagcataatcaaatccaaatcccacacatttcaccaaaaatcctattcctcttcttgtattccttattttgcttaatggatcccaccagtcaacaaacctaaaccttgaatcatcgaaaagtccttccctgtctcccagaatacatacagcttggccataattgcaacgaactgtgctttctaaattgaaccagagtcttccactctctcttgcattctcatgaaaatcatccagactccgccttcattgccactgttcctccacaagccaaaaacctgtcccagattggattccaccagaagtagagcctgagct

SEQ ID NO: 101813 - DNA, 549 bp, Homo sapiens
tatcgagtgcatggctagaggagtgggccacgtgtcagcctggaaagataacttttaaattatcttttaaggtaaacgcgttctcttaatcttccacaccttcatattttcaactctcagttctgtgtagtaatgctcttttctaaaagcccttcaatacaaatgtattcaaatttttctttacagtaaacatctgaatgtctacttatcccccggggtggcctgaaagaatagcataacagcttatatcttattccctgttttacccctttaagtgttacacaccaggcttgtatttttgggtggcgaatttgaggattcttaattcttaccattacattaaggggaaaaatgaccgcatttctagactctgggaaatttttttttcttggaacagagtttcactcttttggccccgggctggagcccaaagtggcgtgatgttgcgtcactcggaactctggcttcctcggtgcaagtgattctcctgcctcagcctcctgagtagctgggattaaaggggcatgctaccacgcctgggttatattt

SEQ ID NO: 101814 - DNA, 156 bp, Homo sapiens
tgtggaaaagagagctcttgcaattctttgctgaggtaactcttcactgtttctgatctccttatttctaagtaataagcatgtactgccatctctttttttttgagatgaactctcactctgttgtccaggctggagtgcagttgtacaatctca

SEQ ID NO: 101815 - DNA, 366 bp, Homo sapiens
aagttgaggggggctgctcttttagacctatgattctcaaattctaatgtgcacaccagtcatctggggatcatgctaaaatgcagattctgattccatggttctgggatgagacctgggactctgcattcctaacaagctcccagatgatgttgatgctgttggtcttggggccctttgagtagtaagggtttgcaacagtgcttcttaaatgtgtgtgtgcaaaagaatcacagggaaggctgattaaaacgtggattcctatttcccatcctgaagattgattcagccggaggcctgataatttgcattttaacaagttcccaggtgatcctgatgctgctggtccccagactacattttaat

SEQ ID NO: 101816 - DNA, 512 bp, Homo sapiens
aattaaagtttattataggtaggtatgtatacaaaaacacagtatatataggcttagtactatcctaggtttcaagtatctactaagggtcttgaaatacatctcgcatgaataaacttgggggactactatactactaaaacttccttgagttagtgttgtaaatatttgaaccataattatagggatgtatactttaagacaatgcattaatagtatgaaacactaataatccaaagaaacaattgtgtttttccaaattttactaaaatgttgtcacctgctttacataatacattcacatatttgatatatatgtaggacaaatagtgtttaagatttcttaaaaatacatttcattttataaaaaataatattttcatgagaagccttgaaaatagctttctcaaatacctatattatatgttgccataacactgaaaatgttggagaaataacttagttcattaacatgcaaaatagaagcatcaattgtaggttaattgcctgag

SEQ ID NO: 101817 - DNA, 142 bp, Homo sapiens
cttgaccatctggctctggttccagtgactccaggacttatatgcccacaagccaaaagaagatcaagatctgagtgggaactgtggaaagcatgtcatgcgagcccctgccgcccttgaaactctgcgttcctcctcctca

SEQ ID NO: 101818 - DNA, 110 bp, Homo sapiens
gggggtgctgctaggtgtgaggtgtaggcgtgagaaacggggaaaggaagatggggccaccagagactgccctgatggatgacatagtcaccacctaggtatcagcatca

SEQ ID NO: 101819 - DNA, 142 bp, Homo sapiens
tgccacaccaagagcatgcatgtgctattcaaggcaggaagcccgacaagtccctgggcccagcagtgagcctctgctgactgcaggttatctgggcctctatccagcagcagcccgtcatcagtctcttcagtttcccgcc

SEQ ID NO: 101820 - DNA, 967 bp, Homo sapiens
gttatgaccacacataaccttcccaccactgcaggaattctatatgatgacctgcccgttatgacctcacagaaccttcccccctctgcaggaatgctacatgatgacctgccctgttatgaccacacagaaccttcccaccaccgcaggaatgctatatgatgacctgccctgttatgatctcatcttcttccctcttcccctccttaatccctggaaaccactgatctgctttctatttctagaattttgtcattgaaaggaggctatgcaaatggaatcacacagtatgccacctttcagaactggctttttcctctcaacataaaccccttgagacccatgccggctgctgcctgtactgatagttcatccctcttccttgctacgtagaatcctggagcagggatggaaaggcactttttaaaataatgcttttgctgctcagaatatctcagtagtcatctttagcaactttggtaaaacctgttaagccctcctccacaatacaggtctcattttcatagttcctagaaaaacttccaaagaaaggattcctgacgggtgttgagagattgtagggccactgggatgagtttatgccaatgcaagaggagttacttgtgtgactctctacgtgggctggaggtggtggggctcatttagaaaaaccaagcagcatctcctgaagccctccctggtgcccacctcccctgatggggatcaccacaggagaggggactgttctagctcccaggctttcgggcacctgggcttataggggaatgcttttggagaggaggctgttagatgccttgaggatgagacactggctttgctgtgttctccagagttgggagggcagggtgctgtggctccatgaagagcatgtgagatgcatcttctttaggggctgcctccgtgagatggaaggcacccaaggaacacagggggtggcaataaatat

SEQ ID NO: 101821 - DNA, 128 bp, Homo sapiens
tttatttcaaggaagaaccctataactttcctacctgtactgtccctgaaaattcaatgttatagacactggcctgaaatcatttactgagtctactaaaagggcattctctcctgtctacctctcag

SEQ ID NO: 101822 - DNA, 366 bp, Homo sapiens
cttctctggaaacattaccatcatcatcatcatctcattgacagcttgtggttgccaggcactgcacatgtagcaacccagtgttgacaccagccatataggaagagttctgtgacatcccatgttacagatgtggacagagaaaggttaagtaacttgcccaaagtcacacgggtgggaagtggcagggcggtctggctcctgaggtgatgtgcttcacctccacacttcacttcttctccagattctaattcccaaacttactaatatcttctaattgctgtaggatattcatcccccatccgtgtctatttatgatctataaccaccttttgtgaatacaaccaataaagttttgtctgtata

SEQ ID NO: 101823 - DNA, 167 bp, Homo sapiens
tgtatttgagcctctagaaaagaagtgtaattataaaaaacatttaccataacctgaacaatgaatgaagaaaggaagacttggttcttctagctctggacaaaattccatttttttaaaaaaaatattgatttccagctgaagtatagtacatctctgatgttttc

SEQ ID NO: 101824 - DNA, 543 bp, Homo sapiens
aacagatttggtcgtactgggtgcctggtgcaccatgactgcttttaactctggtaaagtggatattgttgccatcaatgaccccttcattgacctcaactacatggtctacatgttcctgtatgattctacacatggcaaattccatggcaccgtcaaggctgagaacgggacgcttgtcatcaatggaaaccccatcacccattttccaggaccaagatccctccaaaatcaaatggggtgatgctggcgctgagtacgtcgtagagttcactggtgtcttcaccaccatggagaaggctggggctcacttgcaggggggagccaaaagggtcaacatctctgtcctctctgttgatgcccccatgtttgtgatgggcgtgaaccatgagaagtatgacaacagcctcaagatcgtcagcaatgcctcctgcatcaccaactgcttagcgccccagccaaggtcatccatgacaactttggtatcatagaaggattcatgaccacagttcacaccatcactgccacccagactataaatgg

SEQ ID NO: 101825 - DNA, 602 bp, Homo sapiens
gcagatccctcaccggtagcccccactccaggccagactgaaacaccgcggtgggctcctggagcaccccccacgcccggggctggctggcctgggaggaggggacacaagaacttgggacggcagttctcaaaatgcagtctggggaccgcagaggttcctgagatgctctggggggtctgtgaggccaaacttattttgatgatgaaactgacacattatccgtctttctcattctcgctctcacgaatgttccaagtacaaaacccacgatgcagtttcagatctcacgtcccaacagacctttaagacaggaccgcttgttgtgtttggggatcgaatcgaagcttatccacagttatctgagaggactgccgaggcactcctccctccaagtgtgcggtgaggccagactttccacagatttgcccaaaaccccattgcagtggcttgaacacagaagcagctccgagaaccagctgtctcccgtgaagccagacaccgaacagactggaaaagggaaaaacagtgcatattcctcacagatcttccgttcgggaaacgataatttaattgttttaattaaaaacataatatgtgaa

SEQ ID NO: 101826 - DNA, 308 bp, Homo sapiens
tattgacaccattttatgttcacctgattgcttcctattttctttcagttatgccttcggcattctttagatatcattttacttcatatttgtgtcattagagtggcaatgaagtgttccaagtacacaaccttatattgtaggttttagtaaatgaaaatcactactgactacccagggtctcagtcactttttccatggatctgctgtatgacctttcacttcttccactcttggagcctcatttactgacatgtaaaattagggctgataattttaaacctgttgcttctctaattgaaatattc

SEQ ID NO: 101827 - DNA, 566 bp, Homo sapiens
caggtggcagtctagtaagatttaacgatactgtctgactggagctggaaagcagtgagtatggctgctatcggagaggagagagaaaatcaatctctgtgggctgctattatccagaagaaatggagagctcccaatgaccaggcattccaccgagcaacagggcttacttgcctctgctctcattgaaaaccacacagagcatgcaacactttgctcactccaaaactttatgactttcttcaatttcaagcaatgttgaatgctgactcaataagatacaaccaaaacaacttgttgatgagacaaagctgagtttattttttaccatggtaaaagtgaacgctacctcagcagaggggcaagaaatatattttttgagattttgaagtctggtgcaagtttttcaatgtggaacttggttaagatggggctagcgtcataatgtagttgcttagaattgtgaacgcagggaggagagaattttgagaaaagtaattcaaagggtcttgacatataccattcagtaagttgctggaatgaaaaataaagtcatttgcaattgt

SEQ ID NO: 101828 - DNA, 98 bp, Homo sapiens
gcattcaacccccattcccaaccgtgccgacaaattgctgcttgaagttcctggtcccagaggccttcttaaaatgttcaggaatgcaggcatggaag

SEQ ID NO: 101829 - DNA, 179 bp, Homo sapiens
ggagaggtgaagaagacagaaggaaaagccagggccagttttctttccaagttgtccatggtaactgccatatgctacttatcgcactggccacaacctagtcaggtagtcacacttaggtgtaaagaagctaagaatgtagtcttttttttttttttttttttgatagccatatacca

SEQ ID NO: 101830 - DNA, 604 bp, Homo sapiens
aaaataacctgcacttttaaaaatgtcaaggccacgaaagataaggaaagactgaggaactgacccagattggaggagatttgggagatgcgacaactaaatggaatatggagtcctagactggatattggaactgaaaaaggacattagtggaaaaactagtgcaactcatgtcaatgagttctgtagttcacttaataacagtattctaccaaggtatatgttttggttttgataaatattttttggtgacattagatacgaacataaaggaaagctggtcaaagggtatatagaattctgcaatatttaggcaagaattctgtatgtctgaaattatctttaaaaaactacacacacatccatgcaccgagcaggccaaacaaaatatgtctgtgggtctgattcattcattccattccattcattcattcattccattcaacaagcctttgttgcgcgcctacttggcacaaggcactgtttcaggtactggggagactgcatgaacaaaacctcaaagtcctgcccttatggagctgacactaggtcgagagaaagataacaagtgaaataagtgaactatctagtgtgttagattttg

SEQ ID NO: 101831 - DNA, 174 bp, Homo sapiens
gtagagacagggtttcaccatgttagccaggatggtctcaatctcctgaccttgtgatccacccgccttggcctcccaaagttctgggattacaggtgtgagccaccgcgcccagctggttttggtttttactgtggttactgtgggtgtgggatattgacatgggggtggagg

SEQ ID NO: 101832 - DNA, 245 bp, Homo sapiens
agggggaagagagcatgtggcgggcgtcctttggctcgaaggtttggaagggacagaggacagcaaccaggcagtcccgggagcctgtactgaggctgggtgagagctcctggaaaagctgtggctgtcgcttgctgagctgcctgacgccgtccttgaagggcggggtgctcggacagggccctctcaatgctgtcagaggaacaacgggccctcactgaccctcacccctcacgcaccccaag

SEQ ID NO: 101833 - DNA, 763 bp, Homo sapiens
cttttcatctaccttaccactgtatcctcagcccctagaataaatgcttggcacatacctagtaggtcctcaaatgttggtcaaaataacagaacaagccaatcactgagattccagcccagctccctgggactccacagccttttctctttctgtccatactgtgggtccctctatccctcaaagttcagagctctgggattgcagggacactgactgtctgattagcctttgcttttccacaccagcacagctgattctggcagaggccccggggaagatgctccagctgctttcagtggagagcatgtcaaaatccatctaaccgtggatgagcaaacgtggagtggtgctgacacctggcttttgccgtggattaatgctttagtggtggtttctccctggtgcctagtggttgaaggtggcactgatgagcactatcacttattgcaccgagcttattgattcctcaccatgaccctttgtgtgagggttctccttattcctgttagaagtgaggcttggagaggttaagggatttacccagcacaggcagtggtggacagggaactgggatcaagatctgatggcctctccttcttctctctctctctctttcccctcctctgtctcccaattgtcttggcagaaataatgctttccaggtaagagctaaattcaaaggtttgcttcctagaatagaactcatccctattttcccagggctcatggttctccttctgtagcccagagagaagatgag

SEQ ID NO: 101834 - DNA, 313 bp, Homo sapiens
ttctcttgaagcaaggctagccaataaaaactttgtatgaccatttaaacaaaacgaaacgaaaaacaaaaacaaacaaagcttccttcactcagaccatcctctctgccgatgaaagcccagcctgccatagaaaatcagataggcctctgagcctatgcacattttgttgttttgcctaaaacacttttctaccatctctttgcctggatgactatctcatacttgaagaatcactagaaatgtcactttctccgggagccctacctggactttgtctgtatgtgctcccgcagcgtatggagtttcccca

SEQ ID NO: 101835 - DNA, 94 bp, Homo sapiens
atattcttttccatgtaccaaacattattttattttatttttattttattttgttgagaaagaatcttgctctgtcacccaggctggagtgcag

SEQ ID NO: 101836 - DNA, 180 bp, Homo sapiens
ctttcctgttttaatactatactcagttcatgcaggtccttctgagctggcattgcctgtgagtggtcttttacactttctgcacactatgttgaaggctgggattcaaagtctccctctgtcctagatgtaagtcaaaataaaaagtgaatgaacaaacaagaaagagaaggaaaaaaa

SEQ ID NO: 101837 - DNA, 392 bp, Homo sapiens
attttacagaagagcaaacactgtgtttgacctacatcatctgtcagatatcctaaggctctgaaattagaaaatccctggggtttgctgcattttgctaggctatccattagcttattttgtcaatttttattataagaggacaaaaaaatagaaatcacaatatctgttctaatattcttttatatttgcaagtaaaaacctttggaaaaggttctcaaatagatttataaatgtttttattatatggtacatctagctattatatgtaatgtagtttaacagtatatcattcttgtgtttatctttttatgtaaattcttaagccacacataattttcattaagatcctttgttcaggtaaaattagtagcatttgaaaatggtatatc

SEQ ID NO: 101838 - DNA, 523 bp, Homo sapiens
tacaagtttcattatgtacttaaagggggtaaccaccagaaatgaagttacgtcctcactggggtagatggaccctacgggccatgcagaccctatccggagttgagtgtaatttacggctctgtgtgttttgccaaacaaatccagtgtagataattccagaagaatgacactgggctctagctttctctcattcattttggaacatgcgcatcaaaccaaagttctttctctgcttattccctttaaacatttctaaagtagcacacactttgaagaacctgcttcttgccaagtgaattcagaaaccttggcttccgcttgctggggagactgtcagcatgggcacagatgtgcatgagtttcccactctttgggattctgtgtgttttggtacagccctttgtgcagccgtgggaaccctctgaaccatcccaacctatttgaaaatatttctagagggctgaattttgtcatgggggcaaccccaaagacccaggtttgaagcctggctctgcctctt

SEQ ID NO: 101839 - DNA, 469 bp, Homo sapiens
agccctggtagcaggagtgggggctatgcatggatccagcaatacacactcccactccacaacattgacccagccaccaaggctgacaaaatattcaaccttccagcaacagaaaccaaggatgacccttatccctgcccaggtatggtattagcccttgagactaaccagccatgtggtgggaagttgaatatcttctaccctggaaaggtcattgattcattttagtatgaattaattcatgtttctgggttggatttgctgttcttgcctgcagggcctcagctggcaccagcatctaaaggcttagagagttagtgatccaccaacatggcatctcacataacatcccatcaaaccaagtgacccactttactagaaatgaggtgcacgagtggacaagctccagcttgacccaagtggaacaagctctactagtcccatcagatcatgcaccatccagaagctg

SEQ ID NO: 101840 - DNA, 361 bp, Homo sapiens
taatttgatatgctttgtggatttgcctggcactctgagcaaatgaccaaaaccaattattctgccaggtaggcctctgttctcacgttaataacattctagttgtgagtcatttatgacttcgatgagagagtataaaacaaacagttccattaggggttggtttttccctggacaaatgggtacagagctgggcctgctgatgagctcagcaagaagtccccaccctgggaagccctgccaactgccagcaccttgtattcagcaggctctcagccacacacaggctaagtcacagcccctggccccattaggaatgtgtgtatcctttcctgcctgaatggcccactgagaggtcgtt

SEQ ID NO: 101841 - DNA, 462 bp, Homo sapiens
ctgcccgcctcagcctcccaaagtgctgggattacaggtgtgagccactgtgcccagcctctatccccagttttatattgaattataattagattcaaaagaaacctttcagccagtggtcctcatccttaaactgcatattggaatctcctgggagacgtaatgttgtaggctaaggatataattcaggctattactgaattataaagcgtgctgtgttcatatcctggaggatggaattgggtcacagtgttttcaagtctgaaaaatcagatgccatagttctttgtgtttttaagttagagtccattgccttaagtcctcatgggcattttaagaaatagatcaaagtatttgatgagctcagggtatgggcacccatactttctcctcgctttatccttcaaattagtctacttagaatttgcttttaaatttctgcctaattttaaaaagacaatt

SEQ ID NO: 101842 - DNA, 1258 bp, Homo sapiens
ggaggagaggctgcagctagaggctgggccacaacagtgaaagctgcccctgagtggaatgttgtcagtgtccctccacactggggggctgctgggtgggaggacaaagctgtcctccagaggctgtgcctgaggctgggtgaaagtgggcactgtggcatgtaccatcagacatgtgcagttgactgtggtgagcacaaggctacatttgcagccaagcccaccagaggacccagagctagagggtgatgcttggaccccattctgcagggcagtttctcctcgtatagggtgcatgtctgtttagggccatgagaagcactggttgagtgcttatcaagttccctgtgcccggccacataactttaaacccccagcttagtgactggctacaagagtcaaactctgttcacaagccatgctacctggactcctggttccatttctcaggagtctaccagtgctgccttgccactctgtccaagctttgtaagaatgcccagatgtgtacaaggatgacccatttgtgggcatgtatggcctaaagagcctgcccagccccaaggacttcttagcagagcagggcccttagtgcatctgggtgggcccagagcagctgcagccctctctcctgcacggccagagcgacttagctgggccctgctctgcccgccctgtggccatgcttccatgggctcctgactctcctagggccttcttctggaaagtgctcaagaaccgagacactatcaccaaaactggagactctgggaataggatgtcatgtgttaagcatcagaatgtcccctccaacaagctaagagtgtctactcttgccaccctgtcatcattgtgcttgaggtcaaagccagtgccagaaggcaagaagaaatgaaaaaccatccaggccagaggggaagaaatgaaaccatctccctttgcagatcacatgattgcatagaaaatcctagggaatctacaggaaagttattagaactaataagtgtgtttaagcaaggtctccagatataaggtcaacgtaacaaaaattcatcatatttatataatctatctgtaacagttgaaaattgaaaattttgagaaaagtgccattaataatagcaccaaaaaaaatgaaatacccaattataaataatataaaatatgtgcacattctgtttgctgcaaactgtaaaaccatgatgacaaaaaggcttaaataaaaggaaagataccatgttcatggatcaggtgtctc

SEQ ID NO: 101843 - DNA, 1173 bp, Homo sapiens
ggaggagaggctgcagctagaggctgggccacaacagtgaaagctgcccctgagtggaatgttgtcagtgtccctccacactggggggctgctgggtgggaggacaaagctgtcctccagaggctgtgcctgaggctgggtgaaagtgggcactgtggcatgtaccatcagacatgtgcagttgactgtggtgagcacaaggctacatttgcagccaagcccaccagaggacccagagctagagggtgatgcttggaccccattctgcagggcagtttctcctcgtatagggtgcatgtctgtttagggccatgagaagcactggttgagtgcttatcaagttccctgtgcccggccacataactttaaacccccagcttagtgactggctacaagagtcaaactctgttcacaagccatgctacctggactcctggttccatttctcaggagtctaccagtgctgcgcccagccccaaggacttcttagcagagcagggcccttagtgcatctgggtgggcccagagcagctgcagccctctctcctgcacggccagagcgacttagctgggccctgctctgcccgccctgtggccatgcttccatgggctcctgactctcctagggccttcttctggaaagtgctcaagaaccgagacactatcaccaaaactggagactctgggaataggatgtcatgtgttaagcatcagaatgtcccctccaacaagctaagagtgtctactcttgccaccctgtcatcattgtgcttgaggtcaaagccagtgccagaaggcaagaagaaatgaaaaaccatccaggccagaggggaagaaatgaaaccatctccctttgcagatcacatgattgcatagaaaatcctagggaatctacaggaaagttattagaactaataagtgtgtttaagcaaggtctccagatataaggtcaacgtaacaaaaattcatcatatttatataatctatctgtaacagttgaaaattgaaaattttgagaaaagtgccattaataatagcaccaaaaaaaatgaaatacccaattataaataatataaaatatgtgcacattctgtttgctgcaaactgtaaaaccatgatgacaaaaaggcttaaataaaaggaaagataccatgttcatggatcaggtgtctc

SEQ ID NO: 101844 - DNA, 230 bp, Homo sapiens
tgatttgctcacagaattagaatggctgagtcaaagggtataatgtgtttaaggccatgggctaactgaaacactgctttttagagaggtgaactagattatactctaatcagccatgtgtaagaatgcttgctttaccatatccttgaaagaaatgattcttaacaaattcgtgggtagacttctgtttccagcatcggccaactagatagtttcaaagaagccttctg

SEQ ID NO: 101845 - DNA, 424 bp, Homo sapiens
tccggcatgcctccctggcttcaatcactctattctggagaagtacaggacactttatacctagaggagcctcagcctggacagcgaatctcaaagtttgcattgacaaaagtcattttcccgagttgattgctgatagtccaaatttctgggtctaaacctcagggactctaattcagtagctttgggtgaggttcaggaatctgtagctttggtttgtaactcagggcgaggtctttgctccggctataacttagaagtacataatttgcaaagtttaactggtctgtactgaaatgtttgaccaaaggaaataatttcaatcataacaatgatttctgttataaaagctactattaacccgatttaccatgttccaaggcactgtggtaagtaccatacatgcattatttcatttaattca

SEQ ID NO: 101846 - DNA, 259 bp, Homo sapiens
tggttgctttgagtggctcgcccgttgtctttaggatggttcattcccaattgcttgactgctatgaaagaacttatatgaatcccaggaggtttattagaaacatgttctaagtaatagtaagaaagttggattaacagggtctgcatggaaactctaacctccctccctaaaggaggagaggagcaagatgagtctttccagcttggggcaggcatcgtaagtgtacaatgaccacataatatggcacactatataa

SEQ ID NO: 101847 - DNA, 402 bp, Homo sapiens
tggagatgggtcttgctctgttgcccatactggagtgcagtggtgcaaccatatctcactgtaacctcaaactcatgggctcaagtgatgcttccacctcaatctcttgagtagctgagattatagatgagtgccaccgctaagcaagtgcctggctaacttttgtatttttgatttagtagacatggggtcttgctgtgttgcccaggttggtcttgaacttctggtctcaagagatcctcccgcctcagcctcccaaactgctgggattacaggcatgagccactgtgcccagcctacaattaaccattttttagtgaacaattcagtgctatttagtatattcacaaggttgtacaactaccatctctatttagttccaaaacatttccattacctcaa

SEQ ID NO: 101848 - DNA, 1121 bp, Homo sapiens
cactactgggttatgtccagaggactctaaatggttctaccatgaagacacacgcactcaaatgcccactgcagcaccactcacaacagcaccgacatggaatcaagctggggcctgtcagcggcagacggataaagaggatgtggtccatatacaccgcggaatactatgcagccataaaaaggaacaagatcatgccctttgcaggaacttggatggagctggaggccattatccttcgcaaactaatgcggggacagaatcccgggcactacacttccccacttacaagtggaagctgaatgatgagaacacagggacagaaaggggccaacaacacacactggggccggcctgagggaagagggagaggctcagaaaaccattttaacaaaactgtcaggtacccatgcttggtacccggtgctgaaatgatctgtaggacaaaccctagtcactagtttacctatataccaagcctgcacacagacctgaggctaaaataaacattagcatatttaaaaataaatcaacaaagcctgcacacctgcccgaggctaaaataaacataagaatatttaaaaataagtcaacaaacagtatcttttggtaaatttacccgacagctgaagggataaacaattgtgctggagacacacagggaaaaccactcagcgataaaaggaactgcggacgctccaggaggagtctcccagcctccgtggtgaatgaattcaagcggttagacagaaagtgcgcactgtgattccacatacgtaaaactccaggaaacaccacctcacctaagtgcagcccgcagatgcacgggtgccggggatggggtggggtggggtgggagtgggggcgaggaggcctggttgcagagccccacagtgccgtggtatcttctgtgtcttgactggtcatagttcattcatgtcagacctcaccaaattatacattttacataaatatttaaatgtaaatgtgcaattacatatatttattgacataaaagcattttaaaaaatggctgggtgctatggctcccacctataatccccgcactttgctggtcttgaactcccaacctcaggtgatctgcccgcctcggcctccca

SEQ ID NO: 101849 - DNA, 1218 bp, Homo sapiens
cactactgggttatgtccagaggactctaaatggttctaccatgaagacacacgcactcaaatgcccactgcagcaccactcacaacagcaccgacatggaatcaagctggggcctgtcagcggcagacggataaagaggatgtggtccatatacaccgcggaatactatgcagccataaaaaggaacaagatcatgccctttgcaggaacttggatggagctggaggccattatccttcgcaaactaatgcggggacagaatcccgggcactacacttccccacttacaagtggaagctgaatgatgagaacacagggacagaaaggggccaacaacacacactggggccggcctgagggaagagggagaggctcagaaaaccattttaacaaaactgtcaggtacccatgcttggtacccggtgctgaaatgatctgtaggacaaaccctagtcactagtttacctatataccaagcctgcacacagacctgaggctaaaataaacattagcatatttaaaaataaatcaacaaagcctgcacacctgcccgaggctaaaataaacataagaatatttaaaaataagtcaacaaacagtatcttttggtaaatttacccgacagctgaagggataaacaattgtgctggagacacacagggaaaaccactcagcgataaaaggaactgcggacgctccaggaggagtctcccagcctccgtggtgaatgaattcaagcggttagacagaaagtgcgcactgtgattccacatacgtaaaactccaggaaacaccacctcacctaagtgcagcccgcagatgcacgggtgccggggatggggtggggtggggtgggagtgggggcgaggaggcctggttgcagagccccacagtgccgtggtatcttctgtgtcttgactggtcatagttcattcatgtcagacctcaccaaattatacattttacataaatatttaaatgtaaatgtgcaattacatatatttattgacataaaagcattttaaaaaatggctgggtgctatggctcccacctataatccccgcacttttgttgggattacaggcatgagccactgcgcccggcaaattgggcaaatatttatatacaaattcctaggcacggcaggcatcagggtgaatgctgaacaacataaaagttccccatcacacagctctatggctggcccctctaccca

SEQ ID NO: 101850 - DNA, 505 bp, Homo sapiens
aagtttcctgtgcagaaggaaaaaattgatcgctgttctggtaagaaactggaagatggccctaaattcttgaagtctggtgatgctgccattgttgatacggttcctggcaagcccttgtgtgttgagagcttctcagactatccacctgtgggtcgctttgctgttcatgatctgagacagacagttgtcgtgggtgtcatcaaagcagtggacaaaaaggctgcggaagctggcaaggtcaccaagcctgcccagaaagctcagaaggctaaatgaatgttatccgtaatacctgcctccctggtcttcttaatcagtggtggaagaacagtctcagaactgttcgtttcgactggccatttaagtttaatagtaaaagactggttaatgataataatgcatcgtaaaatcttcagaaggaaagaagaatgttttgtggaccactttggtattatttttgtgtgtgtggcagttttaaattattagttttaaaaattagtac

SEQ ID NO: 101851 - DNA, 84 bp, Homo sapiens
agagcaggatggaggacaggaagaagaaggaagattttctggaagttccacataggacagtgcttacaaatcattggcttaaag

SEQ ID NO: 101852 - DNA, 334 bp, Homo sapiens
tcagggttctgaggattcagaatacaatgtgggtgacttctcagcacagaggctggcacacagcggtccccaggtgaacggtgctgttgatgtcactctatagtagtctgtctttctttagctatgagacaggctgtcacttcacttttggtgttactgagttcttccttgatccacttaacctgtgtttccctaggccacaccagccaggtcattaataataataaattgagattatttggctggtatccttatctgcttctgtggaatctgtgactgcactcaaaagtctcacccacccagtaactcttggagtcgtccccacggcataagg

SEQ ID NO: 101853 - DNA, 413 bp, Homo sapiens
aattttcaaggatgggggtgataagagcaacctttgccattagcccttccaggaccccatgtaagactttagacaccttctcactcatctcagaccttctcagggtaacttggtgaaaatgtcttccgatctgagccccagtgagcctccctgcaacttggcgacgagggactagaccagaaaaggtcaacccgagtgtccctgaccgttgaaatgattggcaaaatggagtgcgtgtctgggtgtggctttttttttttttgaggagtgcccagttgtgattagaattttcaatgggatgcagtgccctaaaaatgaaaaacaaaagcagaagaatggaagaaatagaggtagactcagacacagagaccatcttcaaggcctttctctgtatgaggacatcacagcaaaat

SEQ ID NO: 101854 - DNA, 1527 bp, Homo sapiens
gttgagcttctgtgtcgtttaattacttactcaaaatacaaatcaacatttaaagaaatatattttatatataataaatatcacaaaatatctcatctgacaaaactgcaactagaataggtaacatgggaatttccttatgaattcttatctcttatgcaaacattctagccaatcaaatagatctttcaatacgtgcagtgcctccgtagtgatgcctcatgctaactaactcccttcatcggtaagttatcactgctttaaaccttcagtctctgtccatccatttcctgttaaattcctcctagattcactcaattcatccagccagccattcattaaacaaatattactgagttcatatctacagtagagtgctaggcacccagcacacaacagagagtcaaccaaacatggtccctgccctggaaagcttacagttgaattctcttcccaatcaatgcccattctgcttgtccacctctgggcccctctgtctctcaggctacatgcctgtgctgaagtaccaactaacaggtagctgaccagggttttaccgagtctgtatggtacattaggtgtctgtagggcatggtcatctctgtacaacacaggcctactttctggatttgttatgttggaatagattatctaccctgagtattttcccttatttttgtgatcaaattactttctcttggcaatgccttctttttttttcattaagtacctgggtgcccccaagtggatgatggttctctcacattgcaagagctggttgtacaaaatgcagcacccaagaacttcatgaccatattatcaacctaggagaaaaatgttatggatttgtgcaccaagaaaggaatctaaaatacatttgcatattttataactcatttgaatgtcatcatacccagaaaataaaattcaggccatttttcccttgttaaaaaaaaaaaaaaaaaaaaaaaaaaaaaaaaaaaaaaaaaaaaaaaaaaataaaaaagaaaaaaaaaaaaagaagacagaggcgcgagggcgagcgtagaggaataaataatcttacaacagggagggggagccgcgagtaagcgcgccacaagacgatgtgtagttgggagaagaagggggggcgccacccatcaaagaggacacagtaatcaacaagacggacaaacagcagaggcggcctttatcaataacaaacgccgccgcacaggggagagaacaataaagatgccaacagagagacctattggcgagaagggaaaggcaccacaacagaagcggcggacgcgcaccacaacaaacgacgaacagcaagcaccaccccagacgaaaatagagccgcgcaatgtgagctaagatacaaacagcaaaaagagaggagtcaacgcagagacaacacaggcgaaaaagagcagcgatggcgagacccaagaaaggaaggacgcgcgaaccaggtatgacgagaaacgttaaaaacaggagggcgagaaacgaagagaccacatcgcgaagagaagg

SEQ ID NO: 101855 - DNA, 1023 bp, Homo sapiens
gttgagcttctgtgtcgtttaattacttactcaaaatacaaatcaacatttaaagaaatatattttatatataataaatatcacaaaatatctcatctgacaaaactgcaactagaataggtaacatgggaatttccttatgaattcttatctcttatgcaaacattctagccaatcaaatagatctttcaatacgtgcagtgcctccgtagtgatgcctcatgctaactaactcccttcatcggtaagttatcactgctttaaaccttcagtctctgtccatccatttcctgttaaattcctcctagattcactcaattcatccagccagccattcattaaacaaatattactgagttcatatctacagtagagtgctaggcacccagcacacaacagagagtcaaccaaacatggtccctgccctggaaagcttacagttgaattctcttcccaatcaatgcccattctgcttgtccacctctgggcccctctgtctctcaggctacatgcctgtgctgaagtaccaactaacaggtagctgaccagggttttaccgagtctgtatggtacattaggtgtctgtagggcatggtcatctctgtacaacacaggcctactttctggatttgttatgttggaatagattatctaccctgagtattttcccttatttttgtgatcaaattactttctcttggcaatgccttctttttttttcattaagtacctgggtgcccccaagtggatgatggttctctcacattgcaagagctggttgtacaaaatgcagcacccaagaacttcatgaccatattatcaacctaggagaaaaatgttatggatttgtgcaccaagaaaggaatctaaaatacatttgcatattttataactcatttgaatgtcatcatacccagaaaataaaattcaggccatttttcccttgttaatattcatggtatggtgtggtatgtgtatgtgtgttgggggcatggtacaaacaaggaaggttgatacaagtta

SEQ ID NO: 101856 - DNA, 181 bp, Homo sapiens
cccaaagtgctgggattacaggcgtgagctaccgcatctggcccactctgcctccttaattcagctctcacattgtaaacaagcacccttttcacagtctatttagtgccatgttttttgcatttttgtgccttttttttttttttttttttgagacggagtcttgctctgtcgcccaggc

SEQ ID NO: 101857 - DNA, 608 bp, Homo sapiens
gccccaggctggagaccccaggtcctaggagcctgtgtgggcaccagcaaggtggggacaggtgggcgcggggccgcccccttcagcctgcgcccgcagctctgtgggccccgcacccagggctgccttgagggagcactggctctgtggccatgcttggctctgcgcctctccacctggcttcactgattcagtacctcacttcctctccctgacacgcattctgcgtggagctgaaatgatatggaaggtcctccccatccccaggcacctctgagccagtaaatgtgggttcttctggaagacttggccccgccagtgcacctacggaatcgcgaccatggggtggaagcaaacatctcccctggggacaccgaagcccaagtcaagccccagcactgccgactccatgtgggtgaccgtggacaaagggctgggcccctcagagcctctgagatgcagagtgggtgacgtccaggtcacaggctgcagcgaggttgatgcccaggtccagcactgacgcccagcccgcccagcccaggtgaccacatccccacggctctcgtggcagaagcaccttccctagcacccctacacccctggggtga

SEQ ID NO: 101858 - DNA, 514 bp, Homo sapiens
tggtaatgatggtgatagggtaaagtttggctttttcttggtttttgtttttgcgggactccatcatggatcacccaataggaagccaagaatgaagcagactgggaatgcgagagctcttgtagccaatgcccagccctgcaaatctgccagggaagcagaacagagccaagtggaagtagtgtcctactgggcagggttgggcatctctcccttatccagtggggtctgctccttggagtcaagggtctgtcatgcatccgagggtttggggtctatctctcctcaggatgacccaatgttcagatgggcaaggagaaggcactgcccacagccccagctctccatgtgaccacctaccacaagagtacctccctgcagtgtcggcttggcttatgaaccacaagcacacagggaggggtgcggatggggaatctcccacctgcatctggtctgctgggtaaaatccaactggtgtcagtgcagtccaagtcaccgggagacatgcagtttg

SEQ ID NO: 101859 - DNA, 529 bp, Homo sapiens
tctagtagagatggggtttcaccatgttgcccagggtggtgtcaaactcctgagttcaggtgatccacccgcctcagcctctcaaagtgctgggattacaggcatgagccacctcagggttacacttccttgatgagtttaattcagaagtgaccaggaggttttgcttagccaatgaaacacagatgggcatgatgtgtgttgcgtctgagcagaggcttttcgatccagctcatggctcagcgcctttctgtggtccttctgctatgaaatcagcagcgtcccatggagaggttgacccatcagcctgggttctggagtgaagcaccactggctacactgcagtatgagcaagaaagtaaagctttgctgctgtaaaccactgagattcagggattgtgtgtcatgtggcctaactcagcctagcccagctgactcagtcagtgggagacacaggcaggagatctgcaggccggcagagggcgaggccagggcaactctacttcaggcagagtctctttcaggggcc

SEQ ID NO: 101860 - DNA, 638 bp, Homo sapiens
ccacagctaatattatactcagtgataaaaagttgaaggattttcctctaagatcaagaacaagacaaagatgcccattcccaccactttggctcaaaatggtactacaagtgctagccagagtaattaggcaagaaaagaaaagaaaagaaaaggcatccaaataggaaaggaaaaagtgaaattgtctgtgtagatgatagaattttatatataccaaatccaaaagattccacccaaaaaatattagaactgataaatgaatgaagtaaagttgcaggatacaaaatcaacatacaaaagagtagcactttcatatactaacaatgatctatctgaaaaaaaataagaaaacaatcccatttacaatagcaacaaaagaataaattactttggagtaaatttaaccaaggaagtgaaagatctatatactaaaaactataaacattgatgaaagaaatttaagaatcagttggaaacattaaatatgttaaaagagaaactaaagacataaataagtggaaagatatcctttgttcatgcatcggaataattaatatttaaaaaatgtccatactacccaaagtgatgcaatccctatcaaaattccagtgtcattctttttattttatttattt

SEQ ID NO: 101861 - DNA, 328 bp, Homo sapiens
tgtgcaggagaaacaattttttttctatgatttcaatagttcattctttctctactgatttataatatcacctctattccgtgtcaggtctttgtatacgtaggtctttttttatgctctgaattcagttctattggtctaattgtctattcctacaacaataccacgtggatttaattactgtaacctcataagtttttcaattaattttaaattgagatataatttgcataccataaaattcactccattagagtataaaatttggtgtatttgcagagttgtacaaccatcatcactatttaattgcagcacatttttatcactc

SEQ ID NO: 101862 - DNA, 336 bp, Homo sapiens
cacatggatcaatagaacagaatagagaatccagaaatgaagccacataactacaaccaactgatctttgatagacctgacaagaacatacattgggaaaaggatactcttttcaataaatggtactgggaaaatcggattaccatatgcagatgaatgaaattggatccatatctctggccgtataccaaaatcaactcaagatggattaaagacgtaaacataagacctgaaactataaaaatgctagaagaatacctagggaaaactcttctggatatcggtctaggcaaagaatttatgactaactcctgaaaagcacaggcaacaaaacca

SEQ ID NO: 101863 - DNA, 743 bp, Homo sapiens
ataatttgagtcttaaaaatattcatagttttcaacaggcaaagtagaaaataagggtgtttaatctgaacaacgtgaacaaaggcattctcactccttataatgtctcctgaaaaatggttctattaactggctacagtttcctagagagtttaaattgtcttggaaaatttatacttttttttacaccatcatttatccaatagccactgagtgcctaccatgtggtaggcatttctctatgtccttgggatacaacagtgaagaatcaggcaaaaataattgttattgaggtgcttgcattctgtacaggaatccagtcctccattgccatttaggcaaaatcacttaacctataagttaaccaacaatttaagtcatcctgtactcttcattttaacaccaaaaaaaaaaaattgaaataaagtagtaataattggacattactgtttgtgtcttgagcctaaaaatcactactgatgaataaaaatatctgaacataaacctgtgagcaaaacaaactatctggggttcaatttcagtcaaaattggaattacgtttagtgattatgcctgttcgactatttttgcctggaaatgtttacttgtgtagcagttacttgcttcctaaagtagaatactgaaaatttttcatgaagtgcaaaggacaaatcaaaagtaaactctagttttacagtgtccccatgtttattttgaaagggccctggtagattgtgttgaga

SEQ ID NO: 101864 - DNA, 227 bp, Homo sapiens
gtgtctgtaaactgtgtgtttgtgggtgtgcctgctgttaaccatgctccgccacgtgcatagagagtggttatccatccctgcatggatgcgtatgcttagagaaaactcctttctgggtctgagtgtggtggctcatacctgtaatcccagcactttgggaggccaaggcaggcggttcacctgaggtcaggagttcaagaccagcctggccaacatggtgaaac

SEQ ID NO: 101865 - DNA, 502 bp, Homo sapiens
ctttgtagagatggcgtctctctgtcatccaggctggaatgcagtggcaccatcacagctcactgcatctttcaactcctgagcttcaagggatcctcctgcctcagcctcccaagtaactggagtcacaggcatgggccaccacaccgcgcccagcctgtcttttcattcttaacagtgtctctggcacagcagacatgtttcactttaatgaggtccatcttgtccattttttctttcgtagatggtgtttttgtgttgcatctagaaactcattgccaaacccaaggtcacctagattttctcctatgttattaaacttacagaagtttgctagttttgtgttacatttaggtctatggtctgttttgtgttaattgttgggaaaggtgtaaggtcagtgtttatattcattattccacatgtggatgtctagttgtttccagcactatttattgtaaagacaatcttttctccattaaattgcgtttgctcctctgcc

SEQ ID NO: 101866 - DNA, 714 bp, Homo sapiens
cgcgctgttgcaggctatcgtgtgttaacctgtacttctgccgcagagtttggagaaagcggcagcagattgtgctgccgcaggctggagcctggaacctggagccctggagccttgaatggtgtgtggtggcaatggagagaggcagctggcagtgacagctgctccgtgcttggctacaggaaggaaagaaggagaaagcacctaccataggctggaggctagagcctgcaggactgcggctggcctcgctggctcgcctccctggctggcctcgctgtggttggtggcagcgacggatactgcagctggccagagtgtagaaaggcaatggggagcgcagtcctggtgggcccagcggttcctgtggattggagccaggcagtgtgatgttaccagtcaccactccaggtcccagttcctggcccgcttgagccaaaaggagaggctggactttggagggtggatatgagtgccttcactgagactggcccctgccacccagtggccaggatgacaaggcagaggagaatgaccctgtggccaccaccatcacaggcctatggggcacctcaaactcaactccaaaattgatctaatgaactttcccaaaccacattcccttcttgcatttctgagagaatggattcccattcatctgactacagtgctaccctgaaagcagatccagagactaagattcacctgcaggtg

SEQ ID NO: 101867 - DNA, 340 bp, Homo sapiens
ggcaggcctatcatgtgcagctaagaatgtggactcagcaaccagactgcctggatttgaatcctagcttagctacttattagatctgttatctttggcaagttacttgaccgtcttgtgcttcaatgtcctcatctatacaatgggaacaataatagtaccgtacctatctcatgggatgattatgatgattaagacaaaatgcagtaaatgttagctgctgcattctaccttaattattaacagtgaatattagacaaatccaattttaagttcttagaagataagttctttgagtagaaggactttaacagtggaaagccatctatcagtgtggata

SEQ ID NO: 101868 - DNA, 321 bp, Homo sapiens
agcattctggtagttacatgttttcattaatgtgatttcagagaagcacagaccttatcagatgctgatgtgataaaccaaagtttccttggttggctgtattgtagatactcccctggagccatcacctttttttggaggggggtggtgggtagaggcagggtctcgctacattccccagcctgggctcaaacgatccttctgcctcagcctcccaaagtactaaaattacaggtgtgagccacggtgcttggcctgcattatcattttgtagtgaagttttctttttatttcaagagagaacctattgccatccacttt

SEQ ID NO: 101869 - DNA, 293 bp, Homo sapiens
ctcaactgctctgctcttacaggatccgaagaaatggaatcatcgtatcgctgatctacgtaaacaaactgaagaattgtctgaaagaaaatatgacatgagcttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaatttttttttttttttttttttgagatggagttttcactcttat

SEQ ID NO: 101870 - DNA, 876 bp, Homo sapiens
tttttatccatctccaagttccttcttgggacccagcgtctgattgcctggggcggccacattcctgtccttgtaccttacatggtgcttgtgtgctcccatcatggattgtcaattctcgttggcatccagacgggagacaagtcagcgataagtgccaaggagaagacggaagcgggtgggcccctctgtgtaggacttctgtctgaatcaggtggagggaagacatggggaggagccgcatggctgcagtgccagctgggagagaagtacgggcagagggagctgccgcgaccacatgttttcctgcagcctgttgggtgcgaggggaggcagtaaagctggaagggagtagttgagagccttctgggcatcccaagcccagagcaagcacacttgttgctgccatccctgcccacccctccgtctttttacctatgcctctctgactcctcccattgcatgtgggcatctgttgtggacataaagggaggtacagcaaggcttttttttttaagttggggttctgctttttttacccaggctggagtgcagtggcacaatctcagctcactgcaacctccgcctctgggactcgagcaattctcctgcctcagcctccctagtagctgggattacaggtgcccgccaccacgcccggctaattttttgtatttttggtagagacgggatttcaccatgttggccagcctagtctcgaactcctgacctcaggtgatccacctgcctcagcctcccaaagtgccggcccggccaggctgtgttcttaaggacagatgaggggcagctgcttagacgacccttgaacaatgcaggggtaggggcgccaaccacctgagcagttgaaaatcccca

SEQ ID NO: 101871 - DNA, 456 bp, Homo sapiens
ctaacctccctatctctcttctttgcctcctacatattgtagccatagtgatcttcgtaaactgtccatttgatccttccattttctttaaaatggagtttctttcaaattcttcaatggtcctttgttgccctcacaatttcttatcttgccatgtaattccctcctgttcatctttccagccttacttctcaccatataggcacatacactcacacacacttgctgtcttcctctcttccccatctagccacactgaaacactggcactcgtcccaaaagcaccatgcccttgacctggctaactgctcattgctttgagtctcagcttagttgtcactttcttggcccctcaagatgacgttggtgcccctgcactgtgctcccataaccctctgcctaccgtagcaggcattttatggtttgccttaagttattgtagaggcaaagaaaatt

SEQ ID NO: 101872 - DNA, 212 bp, Homo sapiens
caactggaggttaagtgaaagataagaaaaattgggagatacgccaataaaagatccgcccacagcacaagcagatagcacacagctgacagtaaggatgcttagcaaaagcttgctacaaaacatgtctccaatctggggaactcccgctacatttcaatggccaaaatcctctacccttcagggcagcctaataggaacaccatcacaca

SEQ ID NO: 101873 - DNA, 357 bp, Homo sapiens
gtttatcaattccagaatcaagctgcctgcatttcaccttagacaaattcgttaacttgtctgaactttactttctgatacggtttgactctgtgtccccacccaaatctcatgttgaatcgtagctcccataattcccacgtgttgtggggagggacctagggggaggtaattgaatcataaggacaggtctttcctgtgttgttctcatgatagtgaacaagtcttatgagatctgatgggtttgtaaaggggagtttccctacacaagctctctcattctctcttgttctctgccatgtaagacatgccttttgccttccaccatgattgtgaggcctccccagccatgtggaa

SEQ ID NO: 101874 - DNA, 295 bp, Homo sapiens
ctattgatttaatcaatccacaactgatggacattaaaattgtttccagtgtctggctattacaaaaagtgcctcagtgaacatgctttgtgtatttgtgctgatacttctaaaaggcaggaattccttaagtggaattccttggtctaagaagtatgaacattttaatgtttgagatgtaccactaagttgacctccaaataggctattcaactttatattcctcagataggtacataatagtacactttgctcacactctcatcaacaaggtattattatcaatctgataggt

SEQ ID NO: 101875 - DNA, 462 bp, Homo sapiens
gtgcttggcatgggaaaggtggttctgaagcaccaaggcaggtggcttgtgaatctgcctacattcccctaactctctgaggcttgaaatatcccctcagggctccagagagttgctgttgttcagttatgatgccccatgccctaccagcctctagcaaaaaccatgcatagtgacttgggaaattcttttcactttgctgggccaagacccagatgctctgtgggcatgctgatgggggcctagtggtgttactcctgtattcctccgtagcaaaaaaatagtattaggagagatacagggagatcaggagaatacagcgtcccttcaacttctgcccaaatttctgcagtagcctcctaaccagtttccttatagctctctggttcccttccaatctctcccctcctatgcagccagagggattccttcacactgaaagctaatttgttacactcctgc

SEQ ID NO: 101876 - DNA, 434 bp, Homo sapiens
gaaggtgctggaatttgaaccctgggagccacccccaggtctacctttgcaactcatcagttaaggccctggtgggccctgggtggggagtaggagaggggaagactgaaaacggaggtggtggtgtcccgctcacacgtagtccaatgaggggtgctgctgtgcagggccacacggtgagtacccccaggcctgtttcaaggcatctgaggctgagctgggaggcaggaggggaaagtcgttcagggcatggcggcctgtgagtgaccaccccgtcctcagccagctcaaggagctgcctgtacactgtttggaagcacacagctggttggccagtgcagactttattctctgtattaaagaatcacactaacattgagaccaaccgtaaggaagacaacaaaaccacagggaggagtaaaggccgccacata

SEQ ID NO: 101877 - DNA, 822 bp, Homo sapiens
aactattcaggtatccaaagactgagaataaaaggagatagatgaaattagtccagtggaaaaaaaaaaagcctaatgataaataaacatctggggacaaaaaagaaagaacaaagcaaaacttcctgtatttcttttttaaacatgagtcacagtcacttcccattctccttgtcagattcctataaaaaattcaaaataaaattcaatttttagatgatccaggtctcagatttttggagattttgctcccctgccaactttcctctttcgctttttaggacttgagtcttaaacaaacaactaagtaaaaaagaaatatatttctatttggacatgaaaaaaagctatagagcaaacccattatcttcctttcctttgtaaagctttttgttttgagactggagatagtttggtcagaagaagaaattctaactcatgattctatgaaaaaaaggaaatataaagattcttctcctaattcagtcttccaccacctgcagggagtccaattcttaaaaagtacttcacaaaagaagactgtgttttcaaagcaaactagattttaagaaaccctatgttcgaatgtaaatgaaaaagcaaacgagacattttctaaccttaaagcatactaaaagatttactttttcaagaatcccaatgtatggcaaatttgaattatatttcattaaaccaaggtgtgtaactatctattttaatgagtgagcaaaactgtcatgtggctgtgtactcctgacattccatatctgagttttaagggctatgtaatattaggaccttaattgtaaaagtacaaaagtt

SEQ ID NO: 101878 - DNA, 352 bp, Homo sapiens
ccacctctctgttctctgcttctgaaccacagccgcatcctatttgcagccctcgagattaaggatgaaaatttgactttttaattttattattcttgttcttccttcctacttcattagaatcatgttattggcctaaaatactgtatgtaaaggatgctctggggcccatctggaagcctgcattctctggggatataattacgctaagcaatttttcaccagggacagcatgacttagcttctacctgggcatcctctggcaacacagccctcagttcttccaaagggattggctgctgtcccttcaggccttcttcttggtgtgtgtgtgtgtgtgtgcgtgtgtgtg

SEQ ID NO: 101879 - DNA, 519 bp, Homo sapiens
gctccctgtttgggcaattgtccaaacaattgcctagagatctaaattcttaggttcttgccagtttcatctcctatcattacagcacatgatattgttatttaccattcggcttcaattttctctgcttgttctctatgtgagaacaagttctcttgttctctgcttgttctcatatgtgaatgctagcctggaatgtacttaactttaccatatccttgatttggcgttagagcagggcatagcaaactaaggcccttgggccaatgcagcccaaccattttttttaagtaaagttttaatgcagcacagccatccccattcatttacttactgtctgtgactgcactacaatgggagagttgagtagttgcaacagagacaatgtaacctgtaaagccttaaatatttacttctgaacctttacagaaaatgtttgttgatccctgatctaaagccaagcagttctctcgacctagatactgcttattctttgataatttcccattcccatcttgt

SEQ ID NO: 101880 - DNA, 134 bp, Homo sapiens
ttgtggtgagagtgtattactttaactaacgtttgattattacttctttcattgtgaaaaggaaaagattttattccttggtaaaaggattcctaacagcagctgccaaatgggagggattttggagcaaagga

SEQ ID NO: 101881 - DNA, 668 bp, Homo sapiens
cattgcactccagcctaggcagcaagagcaaaaactccatctcaaaaaaaaaggtttttttttaattataaaaattaaaagggggaaattgtaaaatacaataaaattcctcttcaaaggtttagtcttaactttcttgttctttgttctcaaactcaactttcttgttctccatgcctccttgcccctagttactgtaacaaccttccttcccaacagctctaatcaataattcacatctgttcccttgattactcactctgcagccttcccacccttcaaaaccacacgtcccaccactgtgacttatacatgccccttcccttccttatttggaaaaatatttacaaatagccaatcgggtcagtttagattgtggggtccgaccctagcccatgggggagtaacacagaggaagagactttacgttaaaaataaaaaccccttccctcctttgttcagggtgctcttgcgatcgtgattaatgcaaacaaaaaccttttgcagaagtaaattgccttactaaaaaaaaaaaaaaaaaaaactcgctcgtgccgctcgtgccgaattcggacgagtcgacatggccaagggctgggcaaagagggcccgaggaaacctttttatttccatgctcttaaaaacacggccaatgcaacctggacttg

SEQ ID NO: 101882 - DNA, 159 bp, Homo sapiens
tgcctctctaacagcccacctgaggcttttctagttttcattttcccatccctgtttacacatcattcctgagagatctctgacaggtctccactctgaggacaactgatctgaatcattatttattctgtccctgtgggatgtttagagtaaaaggag

SEQ ID NO: 101883 - DNA, 613 bp, Homo sapiens
tgcaacctccacctcatgggttcaagttgattctcctgcctcagcctcccaagtagcttggattataggcatgcgccaccatgcccgactaattttgtgtttttagtagagatggggttcaccacgttggccaggctggtcgaactcctgacctcaggtgatcgacccacctcggcctcccaaagttgctaggattacaggtgtgagccatctctcctggccatgatacaagataatttatatgaagtaatacactgctggttctgaagtaggtgtgcagtaagtgatgcctactgctgcatgccaagagtcaaatgtatatttgaaagagttgtgaatttcaagaaagatatttttgagtttttttttttttctttctgagacagggtcttgtactgtttcccaggctagagtgcagtggcctgatcttggctcctggctgggcccaagtgatccaccgccctcagccttccaacgtattgggattacgggaatgagccactgcatttggctaagtttttgtttttttttttctctatttttccaaacttatttgattagtaagataaagacattaactgctgttgacagtttccatttttaattagtaatc

SEQ ID NO: 101884 - DNA, 782 bp, Homo sapiens
agcggggtgacgcgcgagcgcggcgcgcagcttgggttcctgccggcgcctctccctccacacctcacctcaaacagagggagccggctccggtctcggccagcccagagagggcctcccatagtgcagcggcgggctgaaggtctcctcaagcgctgccagagtgggcgtcgaggctgaggagacaccgagagcgagtgagggctgccagcatgctgtcacctctcagtaatttgagaaaatttctgttttctatgggttgggagcagcaagtactgcagcccatttgaggtatgataatcagctgattagctagtggagtcgttttccctgaggctcttttgtgtgcaaaatcctcacactcaattgacatgtggacatcataaagctgatgaaatgcaattgtaatgaacaagagggagcggcatctgcagccgtctaaatgaaggaccctttcctctcgccatgctaattcagaaaatctgctcttaacgtgtactccccctggattccaaattgaggcacatctccatgaatgcatattcaaggagtgaattagcctctgtggcaagtgagcgcctagcctggccagactgattctaatttcaagacagattatactgcatcaaccatagtaatgatctgacagttcatttgtgatgagagtcctacagtcagctttactgctcggacagacaggtgcacagagagagccagcaagacctctcagaaaacaccaaaggctgctgtcaaatgatttcagcccaaatagccagatgaag

SEQ ID NO: 101885 - DNA, 105 bp, Homo sapiens
cctcctccttcctctctctcttctgaaacatccccatcctgccactctttctacataaaggctccctagccagcccagcccagctcagcatccctttttccttct

SEQ ID NO: 101886 - DNA, 406 bp, Homo sapiens
cagcttcttatttgaggatatattgggcaaaggggccttcagacaagtagagggagatttttacagaaagattgagatgaaggtatagaaggctgtaaagaccagaaaagagaattgagacagaggaagcaggaagccactgtaggtttttgagcaagatattgatgctgtaagtatggtgtttatgaaaggttagtctggaagagatttgcaggatggagaccccggaagtttttttgttataatacagaaagacttgcactgagggtgaggtgttaaaaataaacaggtaagtaaatgtttaaacatcttgaaggaaaagtcaacaaatcttggcaagtaaacagataacagtgaaaaagaatgggaccaagattttgagttttggagactggtggattgaaca

SEQ ID NO: 101887 - DNA, 435 bp, Homo sapiens
tctatattcttacctagcttgcacaaacctataaataggctcatctcagggttattgctgttataaattaattatggaaatgtcaaccaaatcaggtacgtgccagcagagtaatgggagggcagcgatccactgagcagagggtgattctgatgatgccctctgtgcaaagttcacagcctctggccaggttccatcagcttctagggagtttaaccttgaagaagacactctgggtttgtttcctcctgagtaacggagggagtctggaaaagtgacttccacgactagttctgtgccttcctcttcatagaacctgttgtttctttccctcactgggaactgtaggcaaatttggcaggcctgccttttttcaaacaagatgacggataatctggagcttatctatattgggctaatgttagctacaccact

SEQ ID NO: 101888 - DNA, 159 bp, Homo sapiens
ctgtggtgtcttcagtacttccaaggagcagtgctttggtatatttcactcaaatggtgagagatcccttcctctttccctcctttttctccctttttgcttccagccccttttatttctctttcagcattagaggtctagtgttgccttcatctttgt

SEQ ID NO: 101889 - DNA, 212 bp, Homo sapiens
aaaaaaatcataaaaaagcagccataggaaaaaaaaaagagttgctcttcaaaaaacagtaagactcacaaatttctcaacagaaacaacagaagccaaaatataatagaataacactgttaaagggccaaagagaaaataactgctaatctagaatactatgcccagcaaaactatccttcaaaaataaaggtgaaattttaaaatttgca

SEQ ID NO: 101890 - DNA, 298 bp, Homo sapiens
aacaatagacatttaattctcacagttctggaggttgggaagtctaagaccaaggcgctggcagatctagtgcctggtgagggctcgatttctggtttgcagacagctgccttcttgctgtaacttcacatgactgagagagtgctcggtctctttctcttcttataaggacgccaaccccattcatgaaggctctaccctcacaacctaagcacctcccaaaggcccacctcctaatatcctcacattggaggttaggcttcaaaatgggaattttgttggagggacacaaatatta

SEQ ID NO: 101891 - DNA, 403 bp, Homo sapiens
aggcagacagccctgtgtgggagaaggagatggaggtgggagagcctggctaccctcagcttgggaaggcttccttcaaagcatttccctgctggatgcctgcccaagagagaggcaagcagctgattctcggctttgagggaaaaggaaatacacaagtgttaacagatacattagctcctcacctgcccctgcagtgggggcccccaacattccttttctcaccatttctttgggccaagaaattgaggctcagagagatgaggtcacagagtggtggagaggagggcccagtctctttcttgctccgccaaacaggctctcctgttgggccttcccatcacacctcctcactcctctgatccctggctttttgaatcctaagggagccttggcaattatg

SEQ ID NO: 101892 - DNA, 110 bp, Homo sapiens
aacacagaaagcgacatgtgagcaaacgagagagaaaaatgtttcaggtaagttgacaaaatggtcggtgagccttcactttggttgatatttgggtctttttttttttt

SEQ ID NO: 101893 - DNA, 456 bp, Homo sapiens
ggaccccaccccacaaccgagttgggaaaagatacacattttgtcccctgaagttcctttaagtatgctttgcgtccttacatgaaatgtttataggaatctggaatcatcacagacaatccccctccattaatagttggatccccccaaaacccaccttgtctgccagttagttggaaagctttgtaacttcatgagcccatttctacgaaataatggcccgagacagagaatttctagagacagaaagcagatcagtggttgctgggagtaggaatgggaattaactgcaaacaagcaaaagggatctttgtggggtgatgggaatgttctaaaactagactgtggtaatggttgcataagtctgtaaatatactaaaagttgttgaatcatgtacttaaaatgcatgatatgtaaattctctctcaataaagctgttaaaaaataaacacatg

SEQ ID NO: 101894 - DNA, 356 bp, Homo sapiens
aagatgagtaactactcaaatagctttgctgtgaccattattgtctgatatttgtcaagagatggcccagatttgtaaagaaaccacatccctcaacaaaccagccctgtgcttcattcctcgtcctggtaaatggcaccactgtcccccgctgatgtcaatcagaagattaagcatcatccgggcctctccctttgtttcctttctcactctatgcaagagatatccaggctagcttattctgtgtcttagctcctttcatcattcccctctttgcctctgcacgttgactttcacagacccacttacatattcattatttcttttgggggtggcactacatcctcctaatctga

SEQ ID NO: 101895 - DNA, 83 bp, Homo sapiens
agcttcctacagtaaaacaaagcagagagccacaggcccctggatgacacttggcagccacccccacccccgccaagcagcag

SEQ ID NO: 101896 - DNA, 199 bp, Homo sapiens
ggctggtctcaaaatcttggcttcaagcaatccttctgcctgtctgcctctgaaagtgctgggattgcaggcatgaatcaccatgcccagttaagagttctttatatactgtggatactgactcttacccgatatgtgatttgcaaatattttctcccattatgtaagttgtcttttcacttccttgatagtgtctttg

SEQ ID NO: 101897 - DNA, 585 bp, Homo sapiens
attacattatgggtcacatgctaatcatttaattacagtttttttcaagaggtgaagcctgaaggagcaagctggagatagcaaaattaaccagtctgtcaaagaacaccagggccaaaaagacaagcttttgtgtctttcttagctttgctgtgtctagccctctctcttgtcagaagatgaatagaattagggagctgagcatgacttccttactgaaatggttataactagcctctcaggactgggaactgggtttgatttttaactccaccaagtactttctgcatggtattgggtaagctacttaaacgttttcagccttacattgtgcatatttgaatagggtgggtgataagacttactagaagctatggttgactaaatggcatgatgcctatagagtcctcagtaaatattagctattacgattatcccctaggattctcctaggagaacatttcagacacattcttgtcgaagttagcagcagccagctttagggttagaggtgaacaacggtcaattctgaagcaaagctatctatgttcagaactcatgatatatctctggctcttggtatag

SEQ ID NO: 101898 - DNA, 883 bp, Homo sapiens
aaggaagctgctacattggagatgcctgtgtgaccaggaactgtcccagttcctgcaggaccctcagtcctacaatctgcaagaaatcgaattctgccagcaagcaagtgagtgagtttaagtcatgtcctgttccagccaagcctattaggatgatactgcagccccagaccttaatggtagactctgagagaccctaaaacagaggagccaggtaaacctcgatggctgacctactgaaatcatgagatacccgtgctgttgtttcaagcatctctgctttgagttcatgctgcctattggatggaatctcagagggcgctatcagctggaacactgaacattggccttcccacgtggctggagcttccttacaacatggcgacgagttccaacagtgagcgtgctgaggcagagcccggtgaaagcttcactgccttttgtaacctagccttagagctcatgcagagtcccttccaccaccctgcctctattcactgaggcagtcacaaagactgtccatattcaaggggtaggggactggattccaccgtttgtagggagcagtgccaaagaatttgcggacatgtttcaaaacatacagcccctgctctgtggacactgattatccttgttctggtcccatgtatactctgtgggctactcctttttactgggggatgggaggttgggttttttcagtcctgagtcaaacctcccttcctggggccagtgtgaatatatggggagaaggctgagactgtgaactcacagccagaccagaactgtgtacaatgagagactgaggtttctccaaacaagggacggcaggcagacaaaaacatatgtcctttctgaataataaataaataaacacacaagt

SEQ ID NO: 101899 - DNA, 686 bp, Homo sapiens
ggagatttttgaaacaaagtatgtcatgtcatgattttggaatttagtgcccatatgctgacagatggtttaatgggtctatctgttctagagttttcctaataggtctgaaaatacctctaatcaaaattatttacttgagaaaagtattcagaatagttcctaaaaattaagagtatatcttctgacagcttgcttgaaacagtcttcactgttgaattcaggctcatggtcttaagtagacttcattatagcatttgagaaacaggagtgacacttatagtcataccagagtaaactcagatatgatagatgtattatagcaaatttctggtataaaaggataaataatctgtatatgagtattaatccaatattcttaaaacttcagtattttacttaaaagtactttttgtcattaaaattatagcaaaggtagaatgcacttgtttaatatactctcatgattcttttgcagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 101900 - DNA, 251 bp, Homo sapiens
gcctactactactactatacggctgcttataagacgacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 101901 - DNA, 1203 bp, Homo sapiens
ggagatttttgaaacaaagtatgtcatgtcatgattttggaatttagtgcccatatgctgacagatggtttaatgggtctatctgttctagagttttcctaataggtctgaaaatacctctaatcaaaattatttacttgagaaaagtattcagaatagttcctaaaaattaagagtatatcttctgacagcttgcttgaaacagtcttcactgttgaattcaggctcatggtcttaagtagacttcattatagcatttgagaaacaggagtgacacttatagtcataccagagtaaactcagatatgatagatgtattatagcaaatttctggtataaaaggataaataatctgtatatgagtattaatccaatattcttaaaacttcagtattttacttaaaagtactttttgtcattaaaattatagcaaaggtagaatgcacttgtttaatatactctcatgattcttttgcagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaatcccctctttttctttttttaaaatatatttgagtatgccatacatttatatatatggtgtatatgaatttggtttaaacattttaaaatttattctgattagttgtgtctttttttttttttggagagagagagtcctgctctgtcactcaagctggagtgcagtggtgcgatctcggctcactgcaacctccgcctcccaggtccaagcaattctcttgccttgtcctcccaagtagctgggattataggcacacaccaccatgcctggctaatttgtgtctcattttcaagagtagaaaccctaaatattttattttcattccttttccaaattgctatgaatgggattaaaggattacagatgtaaagtctattatttgtgaattctaaatgtagttctgctgttgtacctgtggaaacatcttaaagaagtacatattttgcacgtcctgcacgtgtaccccagaacttaaactataattaaaaagaatagtttcaaaaaaatacatattga

SEQ ID NO: 101902 - DNA, 409 bp, Homo sapiens
  misc_feature (5)..(5): n is a, c, g, or t
  misc_feature (16)..(17): n is a, c, g, or t
  misc_feature (32)..(32): n is a, c, g, or t
tttgnattagggtgtnnttttaaaggaaaggnacccttagttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaaggctgaaagtgcgtaaatctaactaagaaagagaaagtgcctgcaatcccagcactttgggaggcggagacgggtggattacttgagctcaggatttcgagactagcctgagcaacgtggcagaaaccgcatctctacaaaatatacaaa

SEQ ID NO: 101903 - DNA, 831 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 101904 - DNA, 550 bp, Homo sapiens
tccctggtgggtgatgatggagatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 101905 - DNA, 1444 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctgtgagttgtttacatcgggctccgggtttgttttgggcttctttaccgagagtcatatgggacggatgagtccggctgcctctcgggcctgtagtgtccgagagtggcgaggcggctcaggttgcgcagcgtcttcgcgcgtggcgggcatgtagtgacttgcccggtcaccgcggcgcggctggccctgcaggggcgtgggctgcaattcagaggcggtggctgggaggggaacagttctctgtgtagcttatgagcggtcttggtctttgaggatgcccctgaggttgtgatctttgggtcttttggctttcccagtgattggtgtttctcgccccctctgccttctttcggaagcgatttcctacttgttttccttttttaaaaactgtcctcgttgttgccttatatattaattccgtcaaggacggtcgctcagcaagaattcctgtcagatcagctgttgagccacaggagcaaaaatcacccaggcgctgacgttgtctggtctacttcagcagtttctactctaagcgagtccacagtcggggtcactttctttgcttagcacctcgacttcgcgcagttttcatcgaagacagttcattacgcattggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 101906 - DNA, 478 bp, Homo sapiens
ttattatctatactgacctatctatctacttatctatactgacctatctattggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 101907 - DNA, 1428 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaaaaaaaaaaaaaaaaaaaaaaaaaaaaaaaaaaaaaaaaaaaaaaaaaaaaaaaaacaaaaaaaaacgcaaaaaaaaaaaaaaaaaaaaaaaaagaaaaacaccaacaaataaacaaacaaaaaaaaaaaaacaaaaagacaagggggggcgggcgcctgccgccgtctatcccctactcgcgggaggcggggcgctccgccctgccgaccccccccactccgctcgacgcagcgcgcgcgcgacgatgctacgtctccgcgcgtccgcgcgcgcggggctcggggctgcgagttgtaacacacgtgctcccaggcggcggcaacgataccaacgcaggttcagtcgtcgtggactagctgcgtgacagaaagaccgaccccctgcttctgtgggtggcatgatacaatcagcatcggacgacctgcgtcacatactgacgaggagagatcgaccgtcgtggtctagctgagcagatatcaatctcctcatctgagggacattggcgtgatgtccacgacccgacagagatcattagtggatgacgcgaaagagtgcagagccgcgcgctgctgtacctatcatcaaacacggcga

SEQ ID NO: 101908 - DNA, 1046 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaaaaaaaaaaaaaaaaaaaaaaaaaaaaaaaacaccgtcgggggcattttttgtgggggggcgggaaaagggggtttatggaaggggccaaggggctcataagggtggttctcgggcccagttttttgttgctaccaaggggggaaaaaatgggggggcccccaaaagggggggggggaaaaaaattggagaaaacgcggggtacccggatagag

SEQ ID NO: 101909 - DNA, 992 bp, Homo sapiens
  misc_feature (873)..(873): n is a, c, g, or t
  misc_feature (875)..(875): n is a, c, g, or t
  misc_feature (906)..(906): n is a, c, g, or t
  misc_feature (914)..(914): n is a, c, g, or t
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaaaaaaaaaaaaaaaaaaaaaaaaaaagcggccgctcgaatngncgacgcggccgcgaattcgcggcggcaaacnggggctgncgagaagacgacagaagggaaactctgctggacattagtctaggcaaagatttatagctaagacctcagtacaggcct

SEQ ID NO: 101910 - DNA, 983 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaactaacctaaacctaacttaatccccttccactacaattccctttccccaatcgcttactcccactacatcccttcaccctcagcctttctctattcctcctcccttcctctttcacgcttaccttcgtctctcttcctctgtttttcctt

SEQ ID NO: 101911 - DNA, 852 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaatagtcacgacggaccggctga

SEQ ID NO: 101912 - DNA, 791 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggggagatgtacaacgggccgagc

SEQ ID NO: 101913 - DNA, 1033 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaaggtatatcatttggcattctccaacccagtgatgagattgatgattataaatgtctctatcttcactgaaaagtttaaagaaatcttaatgattaccaaaataacttatctttcattgtgtgctttcagtaaagaatggcctgttcaaatggatatatttatactcttgaccttgcagtgaactccattgacttatttttcttagtttagaacacatttattcacttagtttgcttaacttggaataaattaagtcagaatagaagcaaaagaataactacatgttataggacatgcagatttatttatttatttatttattattttttttttttattaggagtctcgctctgtcacccaggctggagtgcagtggcgccatctcagctcactgcaacttctgcctccccg

SEQ ID NO: 101914 - DNA, 1269 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctgtgagttgtttacatcgggctccgggtttgttttgggcttctttaccgagagtcatatgggacggatgagtccggctgcctctcgggcctgtagtgtccgagagtggcgaggcggctcaggttgcgcagcgtcttcgcgcgtggcgggcatgtagtgacttgcccggtcaccgcggcgcggctggccctgcaggggcgtgggctgcaattcagaggcggtggctgggaggggaacagttctctgtgtagcttatgagcggtcttggtctttgaggatgcccctgaggttgtgatctttgggtcttttggctttcccagtgattggtgtttctcgccccctctgccttctttcggaagcgatttcctacttgttttccttttttaaaaactgtcctcgttgttgccttatatattaattccgtcaaggacggtcgctcagcaagaattcctgtcagatcagctgttgagccacaggagcaaaaatcacccaggcgctgacgttgtctggtctacttcagcagtttctactctaagcgagtccacagtcggggtcactttctttgcttagcacctcgacttcgcgcagttttcatcgaagacagttcattacgcagttgagtaaagaaggacaaagtttgccttaccatatgtttcctgatcgtgcgaaagcccttttctagggacttggagaacacaagtattatgaaaagtactgatgaaagttattaacaggtttcgaaaaataactttactatctgacgtgttgcttctgccgaggatgaccgttattcctgtttttgcatgtatatttcacgtatggttaaatgtgccagcgttgtggtttaaaactaatagtaataatatgc

SEQ ID NO: 101915 - DNA, 1348 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaatcccctctttttctttttttaaaatatatttgagtatgccatacatttatatatatggtgtatatgaatttggtttaaacattttaaaatttattctgattagttgtgtctttttttttttttggagagagagagtcctgctctgtcactcaagctggagtgcagtggtgcgatctcggctcactgcaacctccgcctcccaggtccaagcaattctcttgccttgtcctcccaagtagctgggattataggcacacaccaccatgcctggctaatttgtgtctcattttcaagagtagaaaccctaaatattttattttcattccttttccaaattgctatgaatgggattaaaggattacagatgtaaagtctattatttgtgaattctaaatgtagttctgctgttgtacctgtggaaacatcttaaagaagtacatattttgcacgtcctgcacgtgtaccccagaacttaaactataattaaaaagaatagtttcaaaaaaatacatattga

SEQ ID NO: 101916 - DNA, 791 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccagagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 101917 - DNA, 1103 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaaaaaaaaaaacaaaaaattaaacattaattaaataaaccatttatatttatataatctctccttatttcatcaaattttctatcactctcataaaatatctaaataaaaaaaaaaacctcgaggggggcacaggtcccaatttccccttatgggagtggtttaacaataaatgggccttgtttacaacagtatgaactggaaaaaccctggggtacccaaatttaatcccctttaaaaaaatacccctttatcccaactggctatataatt

SEQ ID NO: 101918 - DNA, 876 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaaatagacccgtcgagcggccgttaatttagtagtagtagtcggc

SEQ ID NO: 101919 - DNA, 1051 bp, Homo sapiens
  misc_feature (832)..(832): n is a, c, g, or t
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaanaaataattcagaacggccaccaaaaagcaggctttggaaacaaagggcctattacttacacatctggaaaaaatttctttggaaggttttcttgccaacaaagggaagaatcaataaggggggggcgcccctccccctgcgttaataaaaaaagcagtattgggaaagcgggcccttcttccgcctcaaaaaattaagccaattaagcgtggtaaactt

SEQ ID NO: 101920 - DNA, 1150 bp, Homo sapiens
  misc_feature (699)..(700): n is a, c, g, or t
  misc_feature (1150)..(1150): n is a, c, g, or t
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagannaagtgcctttattcaattttaacaaacacattcttttttttccccccccaaaatttttaacaacacacaattctttttttcaccccttttttttaaaacacacacacacttttttttttttccccacaaacaaacacacaaccacaggttgtttttttgttttgattcttcttaaaaaaaaaagtggatgcaagcacccataaaaaaataaaagaggagaggaggcgggagccaacaaacaaaaaaaacatttttttttttacaagacaaaaaacacaaaaaatattgtgggggggggggggagcacaaatttttttctattacaacacagaaagatgatacgtctaatgttctttctatatgtattacataagaaacaaactagccgcagagaagaaatagtttttttttttttattcaagaagaaatagagaaagggaagaagagaan

SEQ ID NO: 101921 - DNA, 772 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaaggctgaaagtgcgtaaatctaactaagaaagagaaagtgcctgcaatcccagcactttgggaggcggagacgggtggattacttgagctcaggatttcgagactagcctgagcaacgtggcagaaaccgcatctctacaaaatatacaaa

SEQ ID NO: 101922 - DNA, 351 bp, Homo sapiens
ttctttttttttttttcctactggtacaatacactaagcttacttagatttcaccagctgtatatgtactcattccatatgcttttgtggtctgaagtcatcacttggaggcaccaatggaaaagagcagtgtcagagggctgggattcctctaccagctgtgtgaccttgagtaagccaccttaacctataaacagaaagtaatatctgccctgatacatgatagccaattatttcacttagataaaaactgaatatctactatatatttttatgagatataaggaaagattcttcttgccgctttgccattttttcccataagaagcctggtggtaaagagcacaggct

SEQ ID NO: 101923 - DNA, 426 bp, Homo sapiens
gcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggag

SEQ ID NO: 101924 - DNA, 270 bp, Homo sapiens
aggggtcacagaacacaagaactggaaggaagctgagaggtgggctgctgcctgtgcaccccttcacacatgtggaaacaggtccagggaaggagggccttggatgcctgcaggggtcaggacatctactcactcactcttggtaggtactgtgctaagagagaaaatatatatctaatacaaaaaagtagccaggcatgatggtggcacacgcctgtagtcccagctactcaggaggctgaggcacaagaatcgcttgaatccaggagg

SEQ ID NO: 101925 - DNA, 391 bp, Homo sapiens
acatttgaaaaaggtatatatcaaccacatctcttatctgcaaaataaaagagaagataaaaggaaaataacttttaaagaaatgtgtgtttcaaagtgcaagttttggatgaggacggtgctacaaggcataataaagtagacaaatgcctgcccatatacacagaaccactgtgaacacaactactacagtggcaagatgacaaacactggtgcattgtactgatggctcagttaccaccagtggcattgcattggatgttgatattttctgagatagtataaacatcttgattaaatttcaaataaaaaagtacaatgtttgtactttctacaaagtgccataaacttctttaaaaatttgttatatgaaaacaggaagatgtttttt

SEQ ID NO: 101926 - DNA, 858 bp, Homo sapiens
tggaatgatgactctcatacctctagtcagctattggaagaaatactgtctctcatagctcgacttagataaatgagtcacttccttggtcttctctttttatgaaggtcataaagaattgccacactctaacatattgtataatgccctcgagtgttacaaacgtgttatcccagggcacacagcacaaaggtgagattgtttcttatatgcacacctcaccaattattaggattatcaccctcacacagggaaagagcctatggctgaagtcttgaatctcaaatgcaaacagaatctcaaatgcaaacactgtccacagttggaattgtgactcatgtatgagcctccaaccacagttgagatggtgacacatttctaaactcagaacatagcagatgaggactctactctcttaaacccaacaaattaagagagatgttgactaatacctgggcttagggccacaagtatggtcatgggtgcttacaaacatgattttagagtaaattgtgcctctcatttatactggataaagcctttgagtagtatagtgtactaaccaggcgcagtggctcacgcctgtaatcccagcactttgggaggccgaggtgggtgaaacgaggtcaggagttcaggaccagcctgaccaacatgttgaaaccccatctctactaaaaaatacaaaaaattagctgggcatggtggtgggcacctgtaatcccagctacttgggagcctgaggcaggagaattgcttcaacccgggaggtggaggttgcattgaattgagatcatgccactgtactccagcctgggtgatagtgcgagactctgtctcaccaaaaaaaaaaaaaaa

SEQ ID NO: 101927 - DNA, 229 bp, Homo sapiens
ggttcccaatgtcagcatccccaacacctgcacaccctgacacagacagtcaggaatgacttgagtagtcaaagggcatgacagagagcagcatgtagaaagcagttggcaatttttcaaatataccagtaagggttgtttgtgttcacaatactctggctttgcaggactattctgatgctaaaaagagtctagaaagtttaggtgaacatggttcctaaaggagggg

SEQ ID NO: 101928 - DNA, 433 bp, Homo sapiens
catactggcttaaatactattaagccttagtctagccctgtccttggtgtataattcctacaactggaactgtttgtgcatcttacttaaatttatcagttaatattaggtattatgagttccccttggccttaacccctactcttatcaaagaaacatgtttagaaaatgaagcttatcttccacaggactttaggcataaaatgtgattaagatttattttggctgggcgtggtggctcatgcctgtaatcccagcaccttgggatgcagagacgggtggatcatctgaggtcaggagttcgagaccagcctgaccaatatggtgaaacctcgtctctactaaaactacaaaaaaaaattatttgggtttggtaggatatcagtgatggaagatgaaaggaatgaaatgaagtgagaagggaagtttagag

SEQ ID NO: 101929 - DNA, 279 bp, Homo sapiens
aagtagaatgatggttatcagaggcggggaagggtaatggggggatgaagataaagtggggatgggtaatgggtacaaaaatatagtttgaatgaataagatatagtattcagtagtgcaataggatggctatagttaacaatattttattgtgtattttaaaataactaaaagagtgaaattgcaatattcctgatagaaaaaaatgataaatggttaagatgattgtgatacagtttggctgctagaacatggttaccatgtctttctctctccact

SEQ ID NO: 101930 - DNA, 469 bp, Homo sapiens
gcattccaagcagatcgcatggcccctcacccagccgtggcagcaccgctgttcccaaaccatcaaacctctctcacctatcagtccacgtttttatttttattttttgagaaggtgtctcgttctgtcacccaggctggagtgcagtggtgaggccaaggctcactgcagcctccaactcctaggctcacgtgctcctcatagctcagcctcctgagttgctgggattacaggcgtgagccaccacgtttagctgagtataattttaaatagccctatgtgacaagtggctactttattggacagtgtagatctaagattaattcctcaactgttttgcactcaacaaagacatacctctgagttggcaaccagcagggtggataacgggccagtggtgataaaatcaaagaataggtaatgaaacaatcatccagttaacaatcagcaaggttcttcagagcctaat

SEQ ID NO: 101931 - DNA, 625 bp, Homo sapiens
gtttagttataggaatccatacatcctccttttgtctaaaatagttcatgtgtatttttatcatttgaaaccatacagagatcagttaatacagttggaatatggggcagggtacaatcaggaagttgcaaccctgagagcttttgtttatttaaatgttagttattatagctgagataactggccccttattgctcagtctctctgctgagtcaatgaaagttgaatgtataaatgaataatgcctcttgctccccaccttgtctccccagccaggttcctgatcctcacctgaaatgactttatgctaagttctttttttttttttttttttttgagacaaagtcttgctcttttgcccaggctagagtgtagtggtgcagtctcggttcactgcaacctccgcctcccaggttcaagtgattgtcctgctgtggcctccgagtagctggggttacaggtgctcaccaccatgcctggtgaatttgtattttgaatttgaatacaaattttgaatttgtatttttatggtagagatggggtttcaccatgttggccaggctggtctcgaactcctgacctcaggtgatccacctgcctcggcctcccaaagcgctggaattat

SEQ ID NO: 101932 - DNA, 676 bp, Homo sapiens
gctgcagtgagctaagatcaaatcactgcactcaagcctgggtgaccctgtctcaaaacaaacaaaaaacccagtaggatcacaggtgaatttcctcaagtgtgagcttcctgagtgccctgagctttctttcccagggcctagcacacccactgtagattcctatttacttgtctatctccaacaacagactgtgaactccttcagggcagagttggaggccttttctcactagtctcagcctccaatgtggtctagcacatggtaggtgcatgggaatgaataaatcaatcaaattgcttcatgaaagcaacataatcactcatcaagagcccttttcaccccagcctatcgaaccacatcacccacctgtcttcccaagccttccatcactgttcccttctgtctgcattgctggtgcattcctcctcacaaccccctttcccctttgcacccttgcctctcccttgatgataccacacagatgccagcaccagcttgggagtcccatgggagcaagagccagtggtggcctcctgacccaagttggccacagccctcaaccgctgtgggtcttggggatctttgacttccccctcctggccttgggctcatcactaatgaggggctggggcccacaggggagaagcagtgaccttctctgtgtttgtctgga

SEQ ID NO: 101933 - DNA, 168 bp, Homo sapiens
aaacacacatctcaaattttctttgacaatctcaatttcaaatattccccatagtctattcattccattgtacacattccaacacattcctaggcttctggtttagaaaacaaagtatcatcattttggttaacatactgctatttcccctcctaaatcctctgttcc

SEQ ID NO: 101934 - DNA, 438 bp, Homo sapiens
gaaagctcgctctggtagaagctagcagccatatgagaaatccaactaccatgagatcaccatagcttgaggaagtccagcctcaccacatgaagagaatgtctgggacagaaaatatatggccagtccccaaaaattctacctattctattctatcccagctgaagttctaaacatgtgaacagaaagttactaacactgagtaatagtcttttaaatgagtaacaatgaggcaaaatgggaagatacacaggaaagagtgtaacagtttccatatactggaaagagtataacatctccagcgttttctggagagcagtgttaaaatgtatatgaaactccttgcaatttacctagccttttaaaaaaatattcagcatcgcttaggaagatttatgttaaaggatgttaataccagcattattcataatacaaaaa

SEQ ID NO: 101935 - DNA, 230 bp, Homo sapiens
gaggaggaagagccacgcatgggtgggcaagaggaagaggaagagcattcaggatggagaacaccctaacaaaaagcaaagtgtgcattgcagaaggagcactgaccgcaaaggggcctgaagagaccgcctggcctcaggtgatccacctgctttggcctcccaaaatgctaggattacaggcgtgagccaccgtgcccggccgggaggttttcttagggagatggaaa

SEQ ID NO: 101936 - DNA, 377 bp, Homo sapiens
gagtgttgaaatcttcatttaccatatacttgggttaagtaccatgttgcgcttatatcttttgattttataaatctcattttctttactgtaactcatacagtaccaattaccagcccttgtgtttcttattttcttgggggctctatttaatcttaaatttcatagatcctgatgattttggtctttggaagaacacaatagctttttgtgttgctgaatagctttgtggattaagactgggctgtcatacagagatgatacttgggattcagagattataactgtgaagtataagatggttagcagtctataaaaaaatagcattccatgaccttggcctcattaacactatccctctgaactaatcagctgta

SEQ ID NO: 101937 - DNA, 194 bp, Homo sapiens
ggatttcgcgcgataggcagccatatgtgctagataagaaaggaatagaaaggaatatacatacatcagagggcccagtttctttttcttcctttttaaaattgtttttattttttgagagggagtctcgttctgtcacccatgctggagtgcagtagcgtgatatcagctcactgcagcctctccctcccaga

SEQ ID NO: 101938 - DNA, 644 bp, Homo sapiens
tcattttcctaaactgcttcagggttcaatcctgttattatcacattcagaaattaatcacagttctgttaaaacatctgttttaaataggaagttcaagaaacttcctctcttgatttggacttgtattcctcttttggattcagcttagctaattaaaaatacttccgctaataggttctgtcatttgctctaggaaatttttgaaccagatgatacaaactctcttgggagttctcaaccacctaataatttatttgcttccttccagcagatttcccactctaccatcagcccaaattatctccttacctccccaggatgcagaagtcaccaataatcacagttataactgataaattcttttttggcaagctaattcttatctccagcatagattgctgttttacagatacaagcaaatttgaattagttcccatatataacattaactataaataaaaattaagtaatggaaaaataggtaagtatttgagcaaagcatgctgaggttctactcttttaaacacagatggtaaatacctaggttgttctaagtctatggctagtcacagaatagcatgcaaaataacattatgtgtgaaaactaaggtcactgcgctttttaaatgaggacaacaata

SEQ ID NO: 101939 - DNA, 465 bp, Homo sapiens
agtaggtgctgctgcatcattaggttgggtttagattcctttctgatatggatctagcatctgacacagtactgtcagttaataggagtaagatgtagtgccacctcagttatctgtggacaggagcatattgaaataagggatcagaccaacaaagattaaaacatcagagaaagcaaagatgaagaagagatgcccctgtgttctcagtcactggaagattgggggagttgtgaggggagtgccttcctgctcagtggcatggactagcttgccccctgagaggtgctccgccagtggattggttgcagatggtggttgtggtgtggccatcagtcacctgctcacagcctttttctagtgactggtcccattccagtgctgtgaaaactcccagtgtaccatggattaactttgtcagcctgattttatgtttgggagacaagtaacttttatcctataact

SEQ ID NO: 101940 - DNA, 2475 bp, Homo sapiens
ggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaagtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaagctgcagcggtggcgtaagtagtgttgacctggacatcacttaaagctctggaacagcaaagggcgtacagtggagacgactgcaatacatacttaacagtttaaaaatgtataatatttgggacagggagaggggagtgaaaaaaataaagaataaaattattggaatctaaaataatgatacaggaagtaaacgtattattaatatagacagatctggttctgtctggatgttcttggcttgctctcaggagcaactgagaattagagaaaaactagttttgtttaaccataaagttgttattcaaggagatgtgaagatgacaaagttcatcactaaaattaagaagtcacttctcagtaaaaagctagtatctcattaccattcagctatatgagataccagactactacctatatgttgatacaggaaagtatctgaattggcagaaaataagcccacatcaggcccttccccttagtttctttggggcccttgaccagatcttgataaggtgtgagaaacacaagagctaaggatgggcattcgagttgcaggtaagcctccg

SEQ ID NO: 101941 - DNA, 2190 bp, Homo sapiens
ggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaagtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcat

SEQ ID NO: 101942 - DNA, 2082 bp, Homo sapiens
ggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcat

SEQ ID NO: 101943 - DNA, 971 bp, Homo sapiens
gagtagcgggtaggtccgacagcaggaacaaggcggcagcactcctgcatgctggctgggatggcctcgccgccatctcttgtatcagacacctggccatgggtgaggaaaagaagtgcctttctgatcgtcctgcataaatggagaggcccaaaaccaagagtcatttctcccacagagaaaagggcttttcttaaagttttaccagtctgaaagggattgtttgatacctgacattaatgaacagagactgaagaaagtgaaacaaacttctcattgtgcttaatactctatttctaaacttataaaacaaaaagagaatgatctgtagaggcaaaagatagtaacagtcattggaagtggcctctcggatccttacatttgtctctgtttatccaaagagctgcagcggtggcgtaagtagtgttgacctggacatcacttaaagctctggaacagcaaagggcgtacagtggagacgactgcaatacatacttaacagtttaaaaatgtataatatttgggacagggagaggggagtgaaaaaaataaagaataaaattattggaatctaaaataatgatacaggaagtaaacgtattattaatatagacagatctggttctgtctggatgttcttggcttgctctcaggagcaactgagaattagagaaaaactagttttgtttaaccataaagttgttattcaaggagatgtgaagatgacaaagttcatcactaaaattaagaagtcacttctcagtaaaaagctagtatctcattaccattcagctatatgagataccagactactacctatatgttgatacaggaaagtatctgaattggcagaaaataagcccacatcaggcccttccccttagtttctttggggcccttgaccagatcttgataaggtgtgagaaacacaagagctaaggatgggcattcgagttgcaggtaagcctccg

SEQ ID NO: 101944 - DNA, 561 bp, Homo sapiens
actgtgtcaaaaacaaaaagatgatgtaagagactcacttcatgaagcacatgcgcatcaatcacctggccagggtactcagcagaccaaaaaacaagtagacgccctgattttcaggggtcccttggccttttgaaaaacattttttcaacctgtaattgatttgactttcaacacttagctgcagtccaatgcagaaatctttaatgcacctgtttagaatatgctcttcctgaggcttagccgtggatccttcggcactggatgttagggaagggggtacgtttcggtaaacaatgacagtgacttctgtttggaaccatagtttctttgttggaacgaagctcaactcatataaggagtttggaaccccctaccggacttacaacctccaacttctctctaatgaggctcttgggagctgtacaaaaaggtgaggctggagtttgactgttgtcttctgttgcaggttctgggcatttggaaaagtttctcttcgggctgttaagctagagctggaaagttttctgctcttctggtcatgcatgagtagcgggtgga

SEQ ID NO: 101945 - DNA, 3545 bp, Homo sapiens
ggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaagtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaagtgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaatgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagca

SEQ ID NO: 101946 - DNA, 3532 bp, Homo sapiens
gacctcccctggggtggcagaagcgctcgcctgttcacagccaacggagggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaagtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaagtgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaatgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagca

SEQ ID NO: 101947 - DNA, 3531 bp, Homo sapiens
ccgaagaacatattggctaagatcaggctggtggaaatcggacgaggcggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaagtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaagtgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaatgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagca

SEQ ID NO: 101948 - DNA, 3437 bp, Homo sapiens
ggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaagtgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaatgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagca

SEQ ID NO: 101949 - DNA, 3491 bp, Homo sapiens
ggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagtggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaagtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaagtgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaatgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagca

SEQ ID NO: 101950 - DNA, 3653 bp, Homo sapiens
ggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaagtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaagtgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaatgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcgacactccgatggctcagggatggtaacactgtacagggagaactcacagctccaagagcttccctccaaattatgatgaagttcctgtaaataactagatttcctacagcctggtcctctgcccatgggaaggaggggaaatggatgtgaaaagcaatgtggtctgccctcctgtcattcatagatccagttctgagcacagctcgtgtaatctaccagttcctcag

SEQ ID NO: 101951 - DNA, 2011 bp, Homo sapiens
ccgaagaacatattggctaagatcaggctggtggaaatcggacgaggcggctgacattcacgtttcattctgccacactcgggaacggtgatcggggaagcatggggatccgggagaagcacccacaaaactagcatcctcctggaggagctcggtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaagtgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaatgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagca

SEQ ID NO: 101952 - DNA, 656 bp, Homo sapiens
ccgaagaacatattggctaagatcaggctggtggaaatcggacgaggcggctgacattcacgtttcattctgccacactcgggaacggtgatcggggaagcatggggatccgggagaagcacccacaaaactagcatcctcctggaggagctcggtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcat

SEQ ID NO: 101953 - DNA, 473 bp, Homo sapiens
ccgaagaacatattggctaagatcaggctggtggaaatcggacgaggcggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaaaccggaatttaaaaatccccaacctgtggccatacctgtaagaatgattggacccaacacattacccttacctggattccaaaaaagttttattcaggtcccaaaggcccaggcttaccaactcccccacggttggcttaaaaaaaaggaatggaacaggggacccaaattccacaaaggaattttttaattttaaaaaggccttaaagggggacacgaggttagagaccagagaatgaagaaagacattctag

SEQ ID NO: 101954 - DNA, 3632 bp, Homo sapiens
ggcctggggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagctacactcccacgtgctaaaaagatgaaaggaccaatcaaagatttaattaaagctaaagggaaagagttagagacagagaatgaagaaagaaattctaagttggtggtggacaaaccagaacagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttacgcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactggtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaaaagcaggaacggactgtcatgagccatggctgtgagaacttcaacaccagggattcagtcacaggaaaggagtctcaaggggaaagaccacatttaagtttgttcattccgagggagacgacttaccagtttcattctgtatcgcagtcaagtagtcaaagtcttgcctctctagctacaacatttcttcaagaaaagaaagcagaagcccagaatcataattgtgtccctgatgtaaaggcattaatggagagtcccgagggacagttatctctggagcccaaatctgatagtcagttccaagcatcacacactgggtgccagagccctttatgttcagcccagcgtcacactcctcagagccccttcaccaatcatgctgcagctgctggcaggaagactcttcgcagctgcatggggctggagtggtttccagagctctatcctggttaccttggactaggggtgttgccagggaagcctcagtgttggaatgcaatgacccagaagccacaacttatcagtccccagggggaaagactctcgcaagtttctttgttggaacgaagctcaactcatataaggagtttggaaccccctaccggacttacaacctccaacttctctctaatgaggctcttgggagctgtacaaaaaggctggatcaggtgcaacaccaccataaggaagagtggattcggtggcatcacgatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttcgtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaagtgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaatgcttagatcttgcttccaggcagcagcttgaattcccgaatcttcctgcaaggtgcatacaaatgcagcgtgagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagcagactcttttatactttatggggcatctacatactacttccgccactcttcataataaaattatttgtaaaatataaaaaaaactccc

SEQ ID NO: 101955 - DNA, 357 bp, Homo sapiens
tctgggccataggttggcaaacttgtcttataaagggccagatggtaaatattttaggctttgcaggccatacggttgccgtcacaactactaactctaccattgtggtgtaaaaccagccatagacagtaagtaaaataaatgagcatggctgtgttccaataaaactttatttacaaaagtaggtggcaagatggatttgacctataggccataatctgccaacccctagtttaagcatttgctgtccacttcctaaaatgccagctccaggagagtaaggattttgtcttttttgttcaatactctctggagcaactactaatgtgcctggcacatggtaggcaatccataaat

SEQ ID NO: 101956 - DNA, 585 bp, Homo sapiens
  misc_feature (1)..(1): n is a, c, g, or t
  misc_feature (15)..(15): n is a, c, g, or t
  misc_feature (24)..(24): n is a, c, g, or t
nagtcatcccccagncaaacaggnttacggcccttcaaggcaacaagaggctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcaccaagtgagctcatgtttcaccagaggtggataaaaccaagttctgggctgggcccagtggctcacatctgtaattccagcactttgggaggccgaggcgggcagatcacaaagtcaggagtttgagaccaacctgaccaacatggagaaaccccatctctactaaaaatacaaaattagctggatgtggtggtgcgtgcctgtaatcccagctacttgggaggctgaggcaggagaattgcttgaatccaggaggcggagattgcagagagccaagatcatgccactgcactccagcctgggtgacagcaagactctgtcttgg

SEQ ID NO: 101957 - DNA, 2690 bp, Homo sapiens
gtgacgcgtgggtcgacccacgcgtccgctggaggttggtggatgggcggtgagcgcagcggcgtccgaggcaacaagatggcagctgcggagccgtctccgcggcgcgtgggcttcgtgggcgcgggccgcatggcgggggccatcgcgcagggcctcatcagagcaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcacggctggcccaatgcctggtctggagctggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtggtaggtggggtggcttgaggtctgggagggtggccctggccagccaggacacatgcagacccctggctttagtctggatacaggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcaccaagtgagctcatgtttcaccagaggtggataaaaccaagttctgggctgggcccagtggctcacatctgtaattccagcactttgggaggccgaggcgggcagatcacaaagtcaggagtttgagaccaacctgaccaacatggagaaaccccatctctactaaaaatacaaaattagctggatgtggtggtgcgtgcctgtaatcccagctacttgggaggctgaggcaggagaattgcttgaatccaggaggcggagattgcagagagccaagatcatgccactgcactccagcctgggtgacagcaagactctgtcttgg

SEQ ID NO: 101958 - DNA, 2368 bp, Homo sapiens
gtgacgcgtgggtcgacccacgcgtccgctggaggttggtggatgggcggtgagcgcagcggcgtccgaggcaacaagatggcagctgcggagccgtctccgcggcgcgtgggcttcgtgggcgcgggccgcatggcgggggccatcgcgcagggcctcatcagagcaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcacggctggcccaatgcctggtctggagctggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtggtaggtggggtggcttgaggtctgggagggtggccctggccagccaggacacatgcagacccctggctttagtctggatacaggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcacca

SEQ ID NO: 101959 - DNA, 2241 bp, Homo sapiens
ctggaggcagaggccccagggatctgtgtcctcaccaatgaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcacggctggcccaatgcctggtctggagctggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtggtaggtggggtggcttgaggtctgggagggtggccctggccagccaggacacatgcagacccctggctttagtctggatacaggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcacca

SEQ ID NO: 101960 - DNA, 507 bp, Homo sapiens
ccccacccaaaggccctagaaccctagccttcaatcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcacca

SEQ ID NO: 101961 - DNA, 2217 bp, Homo sapiens
gtgacgcgtgggtcgacccacgcgtccgctggaggttggtggatgggcggtgagcgcagcggcgtccgaggcaacaagatggcagctgcggagccgtctccgcggcgcgtgggcttcgtgggcgcgggccgcatggcgggggccatcgcgcagggcctcatcagagcaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcacggctggcccaatgcctggtctggagctggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcacca

SEQ ID NO: 101962 - DNA, 711 bp, Homo sapiens
gtgacgcgtgggtcgacccacgcgtccgctggaggttggtggatgggcggtgagcgcagcggcgtccgaggcaacaagatggcagctgcggagccgtctccgcggcgcgtgggcttcgtgggcgcgggccgcatggcgggggccatcgcgcagggcctcatcagagcaggaaaagtggaagctcagcacatactggccagtgcaccaacagacaggaacctatgtcactttcaatctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcaccaagtgagctcatgtttcaccagaggtggataaaaccaagttctgggctgggcccagtggctcacatctgtaattccagcactttgggaggccgaggcgggcagatcacaaagtcaggagtttgagaccaacctgaccaacatggagaaaccccatctctactaaaaatacaaaattagctggatgtggtggtgcgtgcctgtaatcccagctacttgggaggctgaggcaggagaattgcttgaatccaggaggcggagattgcagagagccaagatcatgccactgcactccagcctgggtgacagcaagactctgtcttgg

SEQ ID NO: 101963 - DNA, 293 bp, Homo sapiens
ttttttttggtttagactaagaaatggattctggttgtcaagttggacatatataatcataaaccattttgtaacctctcaatgaacattagaaatcactgggaaaatagaagtagaaaatgaatcctgcatggacaaagccatcagaaaacatttacctcaggaaaagaaaagcagttaccacctatatagtccccctccacaacttcttctagtactttctgtctgcatcacgtattctagcactcaatcacatgtcgtactgaataatactaggtgtatattttatcacc

SEQ ID NO: 101964 - DNA, 545 bp, Homo sapiens
attttttttcacttaaaaatttttttgcatagacagggtcttgctatgttgcccaggctggtctcgaactcctgagttcaagcagtcctcttgccttggcctccctaagcactgagattacaggtgtgagccacctcgccggcttaataatatttattaagcccttgctgagtggctggctgtgtactaaaagggctcccagaaagatctctgcaaaagtaggccactccatttatgagagtttttaacccgaagggcctccttcctgatggttaggccccttcctaatggtcagtgaatcttctcaacgctcctatcaggtagctaacatgatcatctccattttacagatgaataaactgaggcacagagcagcaaaagtttggtgggtctgggatgggaatgcaggtctggctggcgccggcgcccaggactctgcagcctcccttctcgcgcggcggtcacgccaccgtgtgccaggactgcgctgggccgcttccagccctgggccgcctgggggaggggtgacctcccgctgccgcgcc

SEQ ID NO: 101965 - DNA, 317 bp, Homo sapiens
tttttgagatgtagtcttgctttgtcacccagactaaagtgcaggggtgcaatcgagattacaggcacccaccaccacacccagctaatttttgtatgtttcgtagagacagggtttcactatgttggccaggctggtctcgaactcctgacctcaagtaatccacccacctcagcctcccaaagtgttgagattacaggcaggagccactgcacccagccacattcttattacatgtgcatgaaacattccacagaatgcaccatattctggggcttcagacaagcctcagcattgaaatcacagaatatgttctc

SEQ ID NO: 101966 - DNA, 325 bp, Homo sapiens
ttgttttccaaaattttgtttggagctctgaatgtttattcctaaatatcaatgtcttaaatagtggcccgctccctagggctcgtccccaaaactgacttgcttggctttttcattgcatgactgaaacatgatgaaaaatactaggaaataatagtataagaccaacgattaaaccaagtagaataggagattcaggttagtagccattccatcattttgctaaaaatggctccgcagaagtgtgaaggttgttgatcctaattttttatcttgtcttagttagggccccgtatgtgggtgtgctgtgcagaccatggggacg

SEQ ID NO: 101967 - DNA, 757 bp, Homo sapiens
  misc_feature (15)..(15): n is a, c, g, or t
  misc_feature (20)..(20): n is a, c, g, or t
gcttcttgtgaccgngcgcnggccttctcgggctaacagcttgaccttgatgttcagcagaacctcgtactcccgggcctggtgttacccctctgctcctgtctgtgtcagctccaactccaggtgcagcaggatccagttgagaagctccatctgcagagcacagggggcctccacctccctcagactggtctccaagctggtcttcagatttctcattgagtccaggttgatctccaaggactggactataagtctcagctctgtgagcatcatctcaacagctccaacctcagcggactgcgtggtgaccactgtggtgctctcttcaatctgctgagaccagtacttgtccagctcttctcaggtcttctgagtcacctcgtcgtattgggccaggatgcctgccatgatcttggcaaggtcctgagacttgggggcatctacttccagggtcaacccagagcctgcaatctgggcttgtaggccttttacttccctttcatggttcttcagaaagaacagctcctctttgagagcctcgatctctgtctccaggtacagccgagagacatttctgtcgtcagtgaccctgtggagcccatgtgagagacaggactagctggatttcctaagccgactaagaatccctaagcctagctgggtgcgtgactgcatccacctttaaacacggggcttgcaacttagctcacacccgaccaatcaggtagtaaagagagctcactaaaatgataat

SEQ ID NO: 101968 - DNA, 247 bp, Homo sapiens
gaaagccaaaatttttaggtgaattttaaaacacagtaaaaaattcagtggtagtttagatcttatgagattaaaagtctctatacaatctacaaagaaataaggagtgatgaaactgctcctgtgaattctctaaaccatgtccaaactgcatatcacatgacaaataaaatctcagtcaaaactgaaaagtctgggcgcagtggctcatgtctctaatcccaggactttgggaggccaagacagg

SEQ ID NO: 101969 - DNA, 2560 bp, Homo sapiens
  misc_feature (2529)..(2529): n is a, c, g, or t
ccttcagcctcctgttgatttatgtacacttatgcttatatgtttaacttttagccaccactaataatgcaggaatataacttttggaccagttttagtagttctgaacttttgaattagataagtattgttactatagtaattttgcatgtaaatatttaacccaaagtgtggcacttgaaattcagttaaacgaaagtatacttggactcatgcctccacttttgccttggttacagtggatacgtccaatactgggagtacttttcatgggattcttggggtgttgctttgccagccggaaacttctgtggctggtggcaccttctgcctgagtattgcctgtgtctgctgggctccttccacccacttggccaggcaggctgcactcagttctcactactggcctggatcccacacctgccaagtgtgagttagacatggagcagcacacggtgtgtgggtgagcaagcacccgctccaatcactgcacacagccaggcatgctggctgctgcagtggggcaagtagctccaggtgccagcacaggcgccagtacaggcaccagctctgtgcgaggctgcagctggaccagatgtactgcatgtggcttccactgtgggcacctgcacctggatgaggggaacaaggtggcgcccggaagcttggagacaccaggaaccacagaaccccaaagagggtgtcacagccctggctcaaggagcccataggtctaggctcctcaaagggctgcagctcttctctcttcaccgcccacaacgtggcaagtggcaaggggtgcgtttcagccctgtttgtgttacagctcttttagtcctgccatttggtggatcctgagttcttgtcccgcatccaggaagaatgaggtatgcagacaactggagggtaagcaaggtgtagaggagcttcattgagtggcagaacagctttcagcagacccaaagtgggtagctcttttctgcaggcaggtcctcccgacatctgtgcagccctcggtggagaggagacctggagtgagtagctcctatctgcaggcaggttgtcctgtcctctgcctgagtctggcagagtctgaggtttttaatgggtttcagaggggagaaagcacgtgctgattggtccatgggcagccatgagctggcctggaaaaagcaccataagttctcactctagtccctggaactggcagcccagcctccaggcctcaggccattccaggcttgaagttggggatttaccggggacccacccctttctgcgcagaagcctgcttcctgatgccatcaacttgccatccatggtgcccacggcgctcaggttgttcgtgccaaggggcacctgcaggtctgcgccaagctgctctcagcccccctcggcttccccctcgtgcttgttggtgcccaaagtttgaagggggctgaggtggcagggggctggtgtgtcagcattgccccaagcatgtgcacacctggtcaggtcacgacagtgcctgggctcagcctcaactttactctgataacggacaaagcaccaggagtagggagatgccaggaagtgggagcagtcacttttgaggctgtgggggcagggggccttcccagtccttgagagtgcagggatgcctgggtccgcagccatggctgggcggctgcagctgttcctggaagggcgagactcctgcccccacagctcagaatggggtggggctcctgcctgttccaagctccgtggagtgtgcagcccctgctgctcctcctccactgcagcccacctcatggcagtgattgctccagacgggctgctgctgccatcagtatgacatgctggtttattgcctgttaccttgtaagtgcccagtcaatgtcagttagtgttagtaatttcttggagtagtcaacttcattaacatttgccatctggttatagcatcacttgtgattccggtacccaacagagtatactttaaaaactgagcaacataaaatctatgatgtttagaaatctgaaatagttgagtcattgtagtacttctttgagtctcttggcctaacagtagtctgggcaatgctactgtgtgtggaagagccaaacctaagtcacagagatcgggtatcttcctgctctgcctcctctcaggcctttcttttgtgtgtcacaatcttcctcctaccaaaaggaaaaagagagaatgaattagtggctaatcttggagaaatagcacaaaataggagtgaattttaaagagcccaatcaggctgggtgtggtggctcacgcctgtaatcctaggactttgggaggctgagaccagtggatcacgaggtcaggagttcaagaccagcctgggcaacatggtgaaaccccgtctctactaaaaatacaaaaattagctgggcatggtggtgcatgcctataatctcagctactcgggaggctgaggcaggagaattgcttgaatctggacccggggggccgaggttgcagtgagctgagctcatgccactgcactntagcctaggctacagagggagactccatctc

SEQ ID NO: 101970 - DNA, 443 bp, Homo sapiens
  misc_feature (389)..(389): n is a, c, g, or t
aaaaaaaaaaaaaaaaggttagtcacccatcgctaccgtatttctaactgtcattttggggaatgttctgagtgcgtttatgcttcacgattactttttatcactgcccacaggtcagaatctgagaggcagggagtttttattcctctttctgaggcctggataaaactgtaataatccttatttacaacttaaggggccaaatcttggttgcctcagtgtgtgagattttatctaatcctctttcagtccttataactacacccggcctccagtcttttttttcttatgtgtagactttacctagttgtaagcagacatttcaggaaccaatgtctttgcctaagggaacataaatgtgggatgtattaaaacgggctaaagttttnaaaaaacaattatttggcttaggatattaatttactaggaattctttgctccat

SEQ ID NO: 101971 - DNA, 924 bp, Homo sapiens
tctgtgctaagctgccttaagctgggggagtgtgccgcatgcggtgtggcctgtgttgggtcatatctgaagctagcacagcactgggtctcacccatagccatggcaaccattgcctggctattgcctatgtttactcaaggtcacagggctctacaatcagcaggtggtgaagctagctaggtttgtgtccttcccctcagcaagttcccatgaatgcctgtcaggttcagaaatgctgtctgggaggtagggcctgtcattggacaccctaggaatctaaccggtgccctattctactgtggctgagctggcacccatactgtcttgtggcacccaagcaacaaggcaaagtccttcccacatttttctcccctttccgcaagcacagcaatctctatccatggccaccaccacaccagactggtgttgtgtactacctggctactgctcaaggcccaaaggctcttcagtgagcttgtggtgaatgttgccaggcctgggactcttcctttagggcagcggtaatccctctggcccagggcaggtccagaaataccatccaagagccaaggtctggaatcagagaccccaagagcccactttgtgctctaccccactgtgtacaagctggtgcctaagctgcaagacagggtctcatttactcttccttctccttttctcaagcataaagagtcccttccaataggtaccatagttgggaatgtgctgggtcacacctgaagctagcatgtttctaagtctcccccaaggctcacagcaagaactgcctatgtatcactgctgattatccagggccaagggctctttagtcagcagtcgtacaatcaactgccagactgtattcttctcaagacagcatgttcccttctggtccagggtatgtctagaaatgttgtccaa

SEQ ID NO: 101972 - DNA, 900 bp, Homo sapiens
aacattttaggaaaaacagccaaaatgtttaacttagcgtttttgctcaactcaatatttaaaataattttcagagatactttttttttttggagacaggatctcactgtcacccaggcgggagtgcactggtgcgatcacaggctcactgcatcctcaacctttcaggctcaggtgatcctcccacctcagcctttcaggtagctgggactataggtgtggcccaccacgcctggctaattttttgtagacagggtttcaccatgttgcccaggctgagagagatagttaaaagtactaaattaaaaaaataagctagaaagaacttaagtcccgttccttcagtttaccagtgatgactttgaacccaaggagttagtgtagagataatatcaaggctgggattacaggcgtgagccacagcgtccggccccaggaggaaaccttttattttttagcacaagaccacttcagtcaaactgggcgcccctttattttgttgggaaaaaattattgctgtctagattctaggaagtgaaactaatcgttatacagttatattgccatgttttaaaataactactatttaaatggtcttaattgtaggtctttgaaacactttagatgaagagatcacaggctgcttaagagtgttccaactaggtattgcagttttcaggtgcttcttaggtgttactattatttgaattgtgtatctgttcagttctgtgctaagcaaggcgatcttcagggagatttcccttccagctacctttggttggagtgttctaggtcacaataaaatgacttagaaaatgaactactcaagaaactaaatattagctccactgaaagagtaaaagtccgtgctgctatctcttacactgggattcattgggg

SEQ ID NO: 101973 - DNA, 185 bp, Homo sapiens
gccccgcttcctgacctctgtccccaggttgtattccagaggcacctcaaaaccctttaaataccctgtgtattgttgagaccagcagaatcttgtgtgatgtttcttcaggagtcttcattttggggcataaagaattaagatagtccagcctgggaaacacagtgagactccatctctacaaa

SEQ ID NO: 101974 - DNA, 415 bp, Homo sapiens
ttgctctgtgaactgtcttcttctccctaagaagccaaaacactgcccataacctccagacaccagggagggtccagggagtactgctgagagcctcaagggagccaatgcagaaacagcagaagtcccttcaataaataggagctcaaggatacactgaagagcatggctggatcctggaaaaggccttgctccgaccgggaagatgtgagactggcccaataggagcaacaaagggcactgcagtgcttccaccacctgattaccagccagatctaaccctaggaagacagaggtccagtccatcccccaaccagccacctacacaacctatgtctcactccttccccaccactttcccaactcagtgctaagggactagaagggaaacagagacttgagttttaggaccatc

SEQ ID NO: 101975 - DNA, 427 bp, Homo sapiens
ctgacctcaggtgatccgcccgccttggcctcccaaagtgctgggattacaggtgtgagccacggtgcccagccacagcaaggctttacataattcagggaacggtctctgggcagcttgaggcctgtgggcggggaggagatgtcttttgcctcacatcatgaaccccttatctgtggccagtggaacaccattaacctgtgggcagtgatggctgagtgtccccaggcttttgcttatagctcaagtctgaccatccagttttccagccttcaggctccccctcctggaatccccactcccttggtccctcctgtctagtttgtgctgactcaaagctggccctcttggacctccagtctgttttggggaaatagctggattctggcaccagtggccctcttggctctgaggcagaggtgagggc

SEQ ID NO: 101976 - DNA, 846 bp, Homo sapiens
taagtgacgcgggcgctggggtccgggggtcccgggggcgcagggtaggggcggcgggaggctccgtggccggccccgggttgaagttggtaattgagcggcaactcaggcgggcgcggagtgacagctcgtgacggcctccgagacgccagctgccccttctcggctgtgtggcttcgacctcctgattctcccacgacgtccctggccgggagacgcgctggactctgcggctggccaaaaggggagggggagccccgcgtcctgggggcccctagcaggggaaggggcgggggttgcgccgggcatcctgtctggggcatctgtctgggactctgccggtgcctctcacctggcgaggggcctgtggtgggggtaggggggaagtccctggcgccaggcttggccaagccctgctctgctggactgcgggctggcggcgctcacccagctcctcacctgtcccgcatcttcctgtttttcttccctttctggttgggcagcgagagttgagaggaggcagatggcttccatcccagaaatcgctctcctctttccatccctacagagagggacagagaggcaaagttccttgcatcccccggggcgctgtccctgtgagctcccggtgtcgtgcacacgtgagcccctgagtcaccgggcttgtgtgtgtgcgatggggctccgtggccagcctggcctcctggggttcactttctgctttcctaccccagctcttcctgtgtggcttagctggccttccactgaggaggcacatgggtttggagggcagatgacagcccactggagagctgtacccctcagtgagggccgccaccttgatgg

SEQ ID NO: 101977 - DNA, 864 bp, Homo sapiens
tgctcactgaattattcttaaaggcttagttttgcttttccaatactgtagataaaatttaaaaaaaaaaaaaaacacagatgacctaaatgttggccttcttcatcttgatttctggatttaaagttactcccaatcttattcctttcataaattattgctttttgaaccattggctattttatgaaaattactcaagagaattaagagattaaagtaattttatattttattaaatggaaagaaatttgatagtactgatggtagaaaaattatcagggtagcaagttgtcactttgatttcaaagcactatccttgcaaagcagtacaaataattaattaactttcccagtttttagtgaaatgaaggatacctgagcttaagcagtttaactcctcagaaaaggatcctgctgtagggtcaagagaacaggggaagtgacaaaggcctccctgggatgggctgtacaaagtaccacaaactggtggcttaaaacaacaaacatttgctttctcacagctctggaggctagaaattggaaatcaaggagttggcagagccgtgctctctctttaggctgttgcctcctcctagattctggttgttgccaacttggaaacttattactccagtctctgcttctgtctttacacagccttctcccctgtgtgtctgggtctctgtggccaaatttccctcttcttataaagataccagtcgtattggatttaggactcaccctaatccagcatgacttcatcttaatttgactacatctgcaaagatcccatttccaaataaggttgcattcacaggttccaggtggacatgaatttggggagacattattcaactcaataca

SEQ ID NO: 101978 - DNA, 391 bp, Homo sapiens
taatcactagaggaaaaggatagtgtctggtcacagaattttgacctgcccagctgcctgcagcaagtttggggtgagggttatcctcttactttgattagactccccacttctgctcccttttgctagtatctaagcgcattacggttttcttcaggtaaatcctacccatcactaattggaagttaacaaggagctacacctgagaggtccctcaccggtggaatgataaggcaggtaggggatggtcacaggggtggtggcacctatgagaaagtcccatggcttggaagagagaggaataatcattcaatccttattcacactgaaggacagatgggtgtatcttttgtctggcaaatggagggcagagaaatagtgctatagcata

SEQ ID NO: 101979 - DNA, 474 bp, Homo sapiens
tttgccggtaaacagtttcaaatggcaaatttcccctaaaattggaaaaaaggctaatacggactggggttggagagcccgggattctgattaaacatggaatctgagaactggcagaaagcctggaactgatggaagagagggctctagggcctccatactaaatggtgaactaggaactataaaagagataatgtggtgaagagcttcagccatcaagttattctaaaaatgaagtagggcattttatatgtggagagaagggcactgattattatctgactattgctaatatgtcccatagaacttatttggaataattttttactattaatttgaacaacagcagtgagactctttatatgtataataaagctaattttacatttaatagagatgattttattttttaatgttagtaaaatcagaatcttattaaattgtaaaagtgaataaaacttttataacttttgg

SEQ ID NO: 101980 - DNA, 450 bp, Homo sapiens
tttttctttttacacaaaattgaaataactacgtttccttagaagacagctttacttctaaggttgttactcagaacaagttttcagtgtgaattataaaacttcatttttttctaatagtaaatgaatcattctagtctttcttcctctatttaatattcacttttacttgttatctaaataatctaatattcatttttacttattatctaaataacaattcatttaaatttccattgggtttccaaaatgaaacatttaatataatttcattaactttaaaaaacagagagggagaaaaaaataaataaataacagtcaatgagcaacacctatggctgagttgtcccaaaacttcacccttagctaaaatgccaaaacaaagccactgcccctggatatttaacatctatatcacacaggaataatacggtttacttaactgtaact

SEQ ID NO: 101981 - DNA, 435 bp, Homo sapiens
tcagacactgaatctgctggtaccttgacttggatttctagtctccagaactgtaagaaataaatttctgtagtttctaagctctctagtcgatggtattttgttatagcagcccaaagaaaccaagataacccttcacaaatatgtaacgtagataccactatgatccttcaatgacctaaaatacaaagtatagggcactggttttatgtaagatgtttttgcaataacaaagcagagattaaagtggctttagtaagtaattcaactttctttactgttcactgactcaactctcttcttcaaacataactgcagaaaaaaggggggaaaagggctgggcacggtggctaatgcctgtaatcccagcactttgggaagccgaggtgggcggatcataaggtcaggagatggagaccatcctggctaacatgg

SEQ ID NO: 101982 - DNA, 572 bp, Homo sapiens
tgggctcaagcaatcctcctgcctcaacctccccagtagctgggactacaggtgcacaccaacatacctgggtgatttttatattttttgtagagacagagttttgccatgttgctcaggctgatctcaaactcttgagctcaagccatctgtctgcctcagcctctcgaagtgctgggattacaggcctgagccaccacacctggccagtaatttcttaatcctacctccctgcttctattgcctagcccgtacatttgaggcttccatggagctttctgtggtactgaaacacttggagtgaactgcaaacttggagtgaactacatccaacctttctaaggtggctggggaaaattcttgtacagcaagttgggacaaaatagccatatagaaacagccatataagatcccaatatagaaaaattgggatattagaggaaatacatgatttccatttatggagtgctacatgtttgcaaaatgtatttctgcttttcatcttcttgacatctgaatattaaaagcagttgttgataatttcatataataaattgagacatatcattaaa

SEQ ID NO: 101983 - DNA, 290 bp, Homo sapiens
tgagatggggtcttactctttcacctaggctggagtgcagtggcacaatcatggctctcaacctcccagcctcaagcaatcctcccaccccagcctctcacacagctgagacaatgggcatgtgccaccatgccttgctaacttaaaaaacattttttttagagacaggagtttcactatgttgtccagactactcttgaactcctagactcaagcaatccccctgccttggcttcccaaagtgcgggattacaggtgtgagccaccatacccatccctaagtatttttt

SEQ ID NO: 101984 - DNA, 488 bp, Homo sapiens
catgagagggagagagaagaaaaagagaatggtggggtctacatttcaaagaggatgtaagtcatatttatttccccagagacctaataaactggtcattccataatgcttagaatactttgagaagaattaagaaacaatttcattttatagtcagcattcccaactatttcattccacaagtgaaatgttaacgggcaaacaatcacaatgctgcaataaattctggaagcataggggttattttccttttgggctgggtcatgatttgagtgatttttcactggttaagttccactattatctgggtgacaccttttgtaataataaccttgctttgctccacatcttgtcatatttatctttcctgaccagctgccattcacactctgaccctgtgatagtagctagtctgccctgacctttgcagctgggaaactcaaaggggctaatgagctaccagttcacacctatcctaattagctatc

SEQ ID NO: 101985 - DNA, 364 bp, Homo sapiens
tgtccgtagaaacaacttttctattctcttaagtttttataatacttaaattacataattgcagcatcaagtacaaatgtcataaatatttttggaggctgggagtagtggctcatgcctgtaatcccagcactttgggaggccaaggcgggtggatcgcttgagctcaggagtttgagaccagtctgggaaacacggcaaaactgtgtctctacaaaaaatacaaaaatttagctgggcatggttgcacatacctgtagtctcagctactcaagaggctgaggtgagagaattgctggagcccaggaggtcaaggttgcagtgagctgtgatcgtgccactgcactctagccttagggacaga

SEQ ID NO: 101986 - DNA, 414 bp, Homo sapiens
tttaagcagtgatattccctgcttaatgaaggtggaaaagggagtgcatttgcagccatttagccaaatctttccctgttaccacatcactttcccaaacacttagaagagatggaggctgacagttccattagagcgagaatgcttgtagactctacaaccttactattcaaggtgtggtccacagaccagcagcctcagcagcaactggctgttggttagaaatgcagaatctcaggccctgccctaatctagacctactgcatcataaccttcattttaccaaaattccaggtgactggtatactcattaaagtttgagaagcactagtagatgagattcattaacattggtcttaaaacgttaatgattaaaaggtactgaccaataggccctggagaaagcagccaaaa

SEQ ID NO: 101987 - DNA, 370 bp, Homo sapiens
aggcagccgtcgcgctgaggcggtggccggggaggggcgcccctcggggtcagcactcagggggcccgaggggagagtgagaatcccgaggctggaagcgcgggcccccacattcgtgtcctctgagagggttcggaattgagccgaacagccgaggtagaacaggtgtcgggccgtttcagctccggcgtcaccctcgtgaccactttctgatatttcctattcccgtgtgctgcagcccaaagtcgcgttccccggaggtgcgaatcgctgttggaacctcggcgccgacgccggcagcaggttaaccgacgtcttcggcagcgtgatgttgactggctccgcttccttctacgattgctacacatcg

SEQ ID NO: 101988 - DNA, 377 bp, Homo sapiens
gcagatgtactaagtccatacatgagtgcagtatttgacagtttgcaaagcaccttcatacccactatctcaccaggtcctgctagctcagtgatgaggtgggacacctaacgtcctcacttccaggtgatgaaatggaggcctggaggagtttctaaagtcgtacaactcctaagtggtggagccaggattagaatgagatattttgacctctggacactgctctttccaccataaactgatatgttccaggagcattgaagaaagcttcctagcatattgggaagaaaactcatggttggggtgtggctgggtggatggatgggcggatggatggatggatggatggatggatggatggatggatggatggatgg

SEQ ID NO: 101989 - DNA, 757 bp, Homo sapiens
gatgggccccctcccctgacccctgtctacactcagccagaagctgatttgagctggtcccacagtgctgcctgtgggaacccaagcccttcctgctcctatctgcctctggctggatgacgccccgggcaattccgcccactgttttgaccccaggccccaaacctaggtgaggaacgccctcctcacagtccttccctgcttccagttcagtgttgacagtgagcagtgctcgctttgctatggctaggccctcactctcctctcttttcaaggccccaagagagtaagccatttattcacaccctatcttgacagcaaagccggggccttgaacctggggcactgctttcagccattattcttgcagaggccccagagctcccagcctgcatttttggagtctgagcagggcccacagctgttttgcttcagctaggagtgaaggctgacaaagagcaaggtctctggagaaggaggaaatgttttctggatgccaaactggtgactgtggggaggtgtggggcagcggggagggaggagctctcacttgtgcctagggaaaggtcatggtcaatgagaaagcctttgatggggagagtctgagatgggacccaggaacatcaccatgaagctgtccaggatggatgtgggaccctctgtcagaccaggccagttctcttaatgtaagatcagcaggccaaggtcctgggatatgggagctcccaggaagtggactgggatgcctgagggatcc

SEQ ID NO: 101990 - DNA, 450 bp, Homo sapiens
ttcatcttcaagtatggcaatgactaataccacagccccaaatttaactcttcaaatcactttcacacatagtatttcacagaaaaacaacactttcaagttaacaaggcagatattattatctggatagataaggaactgaggcccagagatattagaaattcacatgcgtaacaatactcaaatctcccaatgcccagccagcactttgtctatcatatccctgtcttgccttggtgtttgcttactctagagtcaatctgacaaactcaaatttaaacaacaacaaaaaaaacctatgaagggagggacagacagggtttcttaaaaggacataaaaagattgattcaactcagtcctattaacattttctgttcatcaaaagccactgttgaccaggcatggtggctcacgtctataattccaacactttcagaggccaaggtgga

SEQ ID NO: 101991 - DNA, 1576 bp, Homo sapiens
cattgggcacataagaggttcttattcatctgtagagaacaaatttccagtattttcgattttttgcttattttatatatcaaatagaccattaaagaatgttctataaacatttttaaattccaattttcaccaggggaggaatatgtgatatgagtggaatggcaaaaggaaaataaatccacctcaaattcattgattccaatgagaaatgtctatcttttaaatcaagagtaatactattgttaactataccttatgtttttgtatagtttgtttttaaatttagaatattttttccatcttgctctgagcttcctgaccgatagtatataagtaaaaaaaatgcatttatgctacttatttatatcttgtaattcctacacattgaacccttttccccttcttaaccttgtccgtctgcctgagtctttcccaaaacagatagttcctaggcctgtatggtgttaaataacacggtgaggaatttcagtaggttatctccagcaatctgtcttttgggagctatagtgcaaaggccaaagcccattactataaagaccctcttggaggactaagaaggaagatactaattatgataaaggaactataaaacttttaacctcaacagaatttgtaatgtcagaactggagaaattaaaatcagtattaaattttttaattcctaaaataatatatgcatggttgaagagttaaaaacaagtaactttgagagcacagtatgagataaataaaaaaggctaagaatacatgatgaggcacattccccttctgaggagaaagcgaaataacatgtctgtgcattgacccattcattacatttcatgtatcttaagcaaaagagcatgattttctctcattgctaaaaagagttgctttaactcatccctggatttggtggggaaagggtacaactcctgatttgctgtttcactttgaaacaacacaatttgttagatacttagggagatatactgttgaatttgcacaggatgtgactctgtttatacatattaacaaatttccttttggattccttagcagttcatcaaattagtattaaatttttaaatttaaaactagcatgaagggacatgaaatatttgcagtaggtggatctatgtaagatgtttgggtatggcattaatagcttgacaaagatttggggaaaggtgttaagaatgagtccatctcagccaatagtgcttggtgtataattcaagaacagagagttttccatcttgaaaaaacatggaaagtaatgctctatacccatatgtattaataagagcattttccttcttgccgttgatcatttcagatgataccacaatatgagtataattttttattaatcttttttctggtaaaattttagcaatattgtacaaatgctttttttaggttttactgtaaatattaatcaccacgtcacttcagagactagccttttattgctgaattaaatgacatgcatacattgataattatatatctgtattttattaaaaagtacttaaaattatattaaaatatgttattaaaccctttatga

SEQ ID NO: 101992 - DNA, 363 bp, Homo sapiens
ttttttgagatggagtctcactctgtgtgttgcccaggctggagtgcagtggtgcgatctcggctcactgcaacctctgcctcccaggttcaagcgattctcccacctcagcctccccagtagctgggattacagccactgcgcccagctaatttttttgtatttttagtacagactgggtttcaccatgttggccaagctggtctcaaactcctcacctcaagtgatctgcctgcctcagcctcccaaagggctgggattacaggtgccagccactgcaccaggcacaactaattcttataatgattttagataacagtgggaaactgtaacactgaactttagcccagagatgctgattca

SEQ ID NO: 101993 - DNA, 322 bp, Homo sapiens
accagactaatttaaaattataagttttttttcagtgcttatacacatttaaaccatatgcctatgtgcaggagtacacctccaagctgaagtatattcctctgtttaatctttcactagggtctggggtctggaaaattacttcagagccttgaaacaattacttcattttttttctttcttattttagagggagggtctcactatgttgcccaggctggtcttgaactcctgggctcaagcgaccctcctccctcagcctcccaaagtgctgggattgcgggcgtgagccgctgctcctggcccaattacttaatttaaa

SEQ ID NO: 101994 - DNA, 926 bp, Homo sapiens
ggaagttgcagaagtcataacacttgcttgatgcctgataatcttaacatgtatcttctaaaaaccattttctatccatgaaaccatatcacatccaagaaactgaacatcatagaataatgttacctaatgtgtgggccttgtttacatttccccaattgtccacatagatttttttccttaaaaaaatatatatattccatgatctaaggttcacacattgcattaagttgtccgtctctttagtttcatttagctaaaacagttacttccttgtttgaattttttaagatggacattttggaagagtccatgtgaattgttgtatagactgttttacaatctaggttcattagatggtcttcatgattagatttagattaaacatttttggtcagaacgctacctacctaggtgacgtccactcaccagtacatcacatcaagagacactgattgtcagcctggctcagtggctcacacctgtaatcccagcactttgggaggctgaggcaggcgtatcacctgaagtcaggagttcaagaccagcctggccaacatggcaaaaccttgtctctactaaaaagtcaggcgtagtggtgtgtgcctgtaatcccagctactggggaggctgaggcacgagaatctcttgaacccaggaggcagaggttgcagtgagccaagattgcgccactgcactttagcctgggtgacagagcgaggctttgtctcaacaaaaaaagagacattgaatgtcaatttgtatcttcattgataatactaagtttgatcatttggtgaagatggtgtctatgaaaactctactgtaagggtatctgcatcctctctttactaccaagtttgatcatttggtgaagatgatgtctatcagaactctctactgtaagggttcctgcatcctctgtt

SEQ ID NO: 101995 - DNA, 2695 bp, Homo sapiens
  misc_feature (1676)..(1676): n is a, c, g, or t
  misc_feature (2033)..(2033): n is a, c, g, or t
  misc_feature (2042)..(2043): n is a, c, g, or t
  misc_feature (2066)..(2066): n is a, c, g, or t
  misc_feature (2083)..(2084): n is a, c, g, or t
  misc_feature (2089)..(2089): n is a, c, g, or t
  misc_feature (2106)..(2106): n is a, c, g, or t
  misc_feature (2119)..(2119): n is a, c, g, or t
  misc_feature (2123)..(2123): n is a, c, g, or t
  misc_feature (2144)..(2144): n is a, c, g, or t
  misc_feature (2152)..(2152): n is a, c, g, or t
  misc_feature (2165)..(2165): n is a, c, g, or t
  misc_feature (2167)..(2167): n is a, c, g, or t
  misc_feature (2194)..(2194): n is a, c, g, or t
tgggcatagatttcctctttgagaacatcaacctgatttttgagactttttgaaaaaattctttgtgaactacggagggtagaggtatcacacccaactatgaagatcagcatcctgctcatgttcctttggggattatcctgtgctctcccagtaaccaggtatcaaaataatgaatctgaggattctgaagaatggaagggtcatttggctcaggcaccaacaccacccttggagagcagtgagtcatcagaaggcagtaaagttagctcagaggaacaggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaangagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagtaacacagccaaagaggctagtaagcaagaaaggatctgcatgataactttgcagctgagatagttcctaattcatcaacgtaacaaacaaagctattgggtgtccatgtatataccaggcactatgctaggtgttgagaatgtaaagcaggttaagacttgtttcttgctcctgaggagcgtatagagnggacccacnnagctaacagagttaacagagggntatgtataagagaaacnngaatngttacaacccagtatgntgagtgccaaggncagngaggctatgaacacgatatcnatctgggnacactgagaaggntnaccaatgcgttggagaacgagggaggncttcatagcagaagacattggagttggaaggttgcatagggtttcctcattggagaccggggaattctattcttgggataaataatagtaaattctataggattcaatacttagtttgcaaaagcactttgaaattatggcacagtgagttgttttggataagaaaatctttttctcccaattaatttaccaattcatcattttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaatatgtg

SEQ ID NO: 101996 - DNA, 2647 bp, Homo sapiens
  misc_feature (1628)..(1628): n is a, c, g, or t
  misc_feature (1985)..(1985): n is a, c, g, or t
  misc_feature (1994)..(1995): n is a, c, g, or t
  misc_feature (2018)..(2018): n is a, c, g, or t
  misc_feature (2035)..(2036): n is a, c, g, or t
  misc_feature (2041)..(2041): n is a, c, g, or t
  misc_feature (2058)..(2058): n is a, c, g, or t
  misc_feature (2071)..(2071): n is a, c, g, or t
  misc_feature (2075)..(2075): n is a, c, g, or t
  misc_feature (2096)..(2096): n is a, c, g, or t
  misc_feature (2104)..(2104): n is a, c, g, or t
  misc_feature (2117)..(2117): n is a, c, g, or t
  misc_feature (2119)..(2119): n is a, c, g, or t
  misc_feature (2146)..(2146): n is a, c, g, or t
tgggcatagatttcctctttgagaacatcaacctgatttttgagactttttgaaaaaattctttgtgaactacggagggtagaggtatcacacccaactatgaagatcagcatcctgctcatgttcctttggggattatcctgtgctctcccagtaaccaggtatcaaaataatgaatctgaggattctgaagaatggaagggtcatttggctcaggcaccaacaccacccttggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaangagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagtaacacagccaaagaggctagtaagcaagaaaggatctgcatgataactttgcagctgagatagttcctaattcatcaacgtaacaaacaaagctattgggtgtccatgtatataccaggcactatgctaggtgttgagaatgtaaagcaggttaagacttgtttcttgctcctgaggagcgtatagagnggacccacnnagctaacagagttaacagagggntatgtataagagaaacnngaatngttacaacccagtatgntgagtgccaaggncagngaggctatgaacacgatatcnatctgggnacactgagaaggntnaccaatgcgttggagaacgagggaggncttcatagcagaagacattggagttggaaggttgcatagggtttcctcattggagaccggggaattctattcttgggataaataatagtaaattctataggattcaatacttagtttgcaaaagcactttgaaattatggcacagtgagttgttttggataagaaaatctttttctcccaattaatttaccaattcatcattttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaatatgtg

SEQ ID NO: 101997 - DNA, 247 bp, Homo sapiens
actgcactctagcctgggtgacagagcgaggctccgtcaaagtgaaagaaaagagagagagagagaaagggaggaaggaaagagagaaagagaaagaaagtcagtccatggtttccaaaacatacttctgtttccattaatttattaggaatgctcttccatctggctgttgatctgtgtcctgtgtaacatcctttataacaaatggtacacctcagtaaattgtttctccaagttgtgtaaatca

SEQ ID NO: 101998 - DNA, 717 bp, Homo sapiens
gtttaaatgattaatctgggaataagttttttttaattttgttatctgttttctttttttagtttttttttctaattttcttaagtttttgtttgtttttgagacagagacactctgtcacccatgcttgagtgcagtggctaatcagagctcactgtagtcttgatttcctgggctcaagcaatcctcctacctcagcctcctgagtagctgggaatacaggtgtatgccaccatgtctggctaattttttttttttctatagagataggattttattatgttgcccaagtgggtcctgaacttttggccttgagtgattccccccacctttgcctcttaaagtgctgagattacaggtgtgagccattgctcctggctgggtatataggttttgagaggaagaacatacatgtaaaataacattttcatcacatcataacaagggtacatactgtcaacacaacttaccactataaagttgaccttcatcacctgccagtgatagtgtttttcaggtttctccaccgtaaagttactttctccccacatcttcccacccaaccagttcatactgtgccttttggaaggaagtcactatgcacagaccacatctaaggaatgggaattatgctccccttttttgaggttggagaatatatataagttatttggaattcttctgcaaagaagatttgtttcttctctcatttattta

SEQ ID NO: 101999 - DNA, 413 bp, Homo sapiens
ggaggctctcaaaggaattaattataagcaggggatataggggtattgtgaaagaagaacagataaatcccattgtatgaaacagtatgtagaacaagtgaaaggaaaagatgagacaagacaaaacattaaggttttaaacttacatacctcagagaatgaggtcattatcagaaagaggaaacattaaaggaagagcaagtatcaagaaatgatgagcttgctttgaagcactcagaggacacgatggggaatctcagcaagcactgggagatgtatctggagtgatgcagagataatagtgatagagatatttgggagtctgtattctacactaaggtaatacctgatgctaagaatgaataaccaccatcagagcatgtagagaaaacaaaattccaagagcataacct

SEQ ID NO: 102000 - DNA, 217 bp, Homo sapiens
ccttggccatttttctataaaggcattttttgtcttattgatctatagaatgttaatatattctaaataacaattcagatttatcttgcaagtatcttctgccagcctgctgtttgccttttttattcttgagacagggtctggctctgtcatccatgcgggagtatagtggtatcatcttggctcaatgcaacctccgcctcccaggctcaaacga

SEQ ID NO: 102001 - DNA, 336 bp, Homo sapiens
ttttttttttgaggtggagtctcggtctgtcacccaggctggatggagtgcagtggcacgatctcggctcactgcaacctccgcctcctgggttgaaggaattctcctgtctcagcctcctgagtagctggggctacatgcacatgccaccatgcctggctgatttttttttgtatttttagtacagacagggtttcaccatattggtcaggctggtctcgaactccctcggcctcccaaagtgctgggattacaggcatgagccactgcacacatatttctatgtatttctaacagttactgagcatcactgagactctggactctgttttttca

SEQ ID NO: 102002 - DNA, 1004 bp, Homo sapiens
agcgcccactccaccgcgtggtttccagctggaggctgggagcgttcgtggcttcctcttttcttgctgacccttcggagctctgggaagtggctgcaccttggcggctccccagagcgcgcggtgctaatcgtgggtcgtcagcctgggtggctgggcccggcttagggcagggtttggcatttccaatggtagggggctcggaccgtccctccgcgggaccctcccgttgggacaaggccgatcgcctgggcggttggagccgctatcctggcgcgagacggtggacaagtcctatattcaagagaagataactttgaacagtttcgaaggatctaaaacgtatgtgtctgcagacatcaatgaggatgaagaattagtagaagagattaatagatcaaaaacgtttgctggctttgcaggtggtgggcctgcctgggcatcggcgcgttggaggagacgccctggggggccttagctgccctgaagcggtagacaggtggcaacgtgggggctcaggagttgacaaacacaagaaagcagcgccgaattgcaggtttatccgcagcttttattttgaagacagtgccacgaaacctgcaaatcctggtgtcccaaatagtcaataccaagttgaaaaccatctgggagaggaaaagcgttgtgctttagacaggccgtctgagactcgtgcagaccggcttttgagagctggacaggtggtggatagatcagactccatacacccgaggagccccgcatgcatagtgaagaagctagataacagtcgtttcacaactggccagcctctgcgccacttgaccccgagagagctggccagtgctgggctgtactacacaggcactgatgaccaagtgcagtgcttctgttgtggcggaaaactgaaaaactgggaacctggtgatcgtgcctggtcagaacacaggagacattttcctaattgcttctttattttgggccacaacgttaatattcgaggtgaa

SEQ ID NO: 102003 - DNA, 765 bp, Homo sapiens
agcaggacaagaggccatatgcagttttccccttggctgatcttttcttcttgtggcttattccacaaacaagatgcagaatggcatatacagaaccctgcaacggcccagcctcatcacaagagaggaacagaccatagaggggtggggcagaaagaggaatgatttttttttaactgcgccttttaaactgcgaagcagctaagctccatatatacagaagagccccatggaagtctgggtgtatatagggttatgttttccaggtatgctaagtttctagtgcccagattagccaactgctagctagaatatttttcccactgtaattgcatttaaaaggggaaaatacaaaaggggaaaataaatttgaagagtttcaaatgtatgggataacaaagagaaaaaatacagctctattaagacccaatgataggagctgtctccattgcacatttttattctttctccgaggtcaccaatgtctcaaataccatgtcaaaggaaggagacgggtatataggaaatgttttctctcaagtatgctaagttcccagtgcccaaattagatgacttcttgctggaatattgctctcattgcaattgcatttaaggtcacaggtcatatgttttggacaactgatatcaactgactggcttcctggtgcaactgaactcttcctcttttgggactccacgcagttaccattgtatctctagcttgtgacaactcttaagtaaaatactgtgttctgggaacacaat

SEQ ID NO: 102004 - DNA, 763 bp, Homo sapiens
ttctccatgttggtcaggctggtctggaactccgacctcaggtgatccacccgcctcggccttccaaagtgctgggattacaggcacgagccaccgcgcccggcttgttttttaaatcttattttataatcatgtttgttccttatgttaccattattttagatgatgcttatcttttaattgatattcttagcctaaaaagttgcttaactttattatgcatttgtaaaataggactacttatttgttatttgctcttcatttattaccaatttttggttaataaatccatgactatctgcctcatacatcattttatagatgccaatcatattcttgctcagccttgtctgtccagaaaacaaaaggcttctttaaataaaatttttcctcatatagttatcctcatacccctgttttcttgaatcactttacttcttagacctgatccagaatgaagtctttcctgagggttcagtgatcaaccaataaccccagggtggaaacattgtggttttgtacaaagacagaatgctttggtgatgacctgatcatcaactgccttctcaatgccacttagaataaatgactctagctaatacatcttgtccctaacagaggcctggagcaagagaggaaaagtaacattggagccctggagacatttgcccaactctatggctaccttacccctagtctgtagccctaagatctatcaggacctgtggtctcatttctagagatctcactcttgttgagaatt

SEQ ID NO: 102005 - DNA, 435 bp, Homo sapiens
agaagggaggtcagcctcacaggtcccaaacccagggatttctcgtaagaatcagtttcccgagagtctcctgaccctatttttccccttacaataactccccatccaaaggtaaattctcagtctcatcccctccacctaaagatggagggagagggaggtaaaaattcccacctgttcccaccccacctgggcttccactactaccctgcttctatggacatggtgaagataccaaaagaggaagaatcgtgggcccagagcctcaaccccagcagatgccctttctcccttcattccagacaagccccaggccaaggcacacatgcctgctgtggggaccaaggggagtgagaagcaacatacaccaccaccaggtcaagagcctgacctcagcccacttgccattagtgcatccataccacacccagccca

SEQ ID NO: 102006 - DNA, 247 bp, Homo sapiens
tccttagaatataagctccatgacaataaagatttttgtctgctttacatggtgatgtattttaaggcctgaagcagtgtctggcacataatatacaataaatacttggtgaattatataattgaaagaatggaaaaacaatataggaactcatttgatttaatctaatccacaaacctttgaaataggtgattattattcttaatttataggagaggaaaaggaggctctgcataggcaggaaata

SEQ ID NO: 102007 - DNA, 696 bp, Homo sapiens
tgtattggttgctttatttcatttcataaatcaaattacggatgtagtatagtacatgtattttatgtttcagctaaggaaaaatccttaggtaattcacatattctgatgtgaattttatttacatttttttttttcagatggagtctcactctattgcccaggctggagagcagtggcaggatcttggctcactgcaacctccacctcccaggttcaagcaattctcttacctcagcctcccgagtagctgggattacaggcacgtgacaccatgctcagctaatttttgtatttttagtagaggcgaggtttcaccatgttggccaggctggtcttgaactcctgacctcaagtgatccacccgtgttggtcttctgaagtgctgggattcaggcgtgagccatcacgcccggcctattcacatattctgatgtgaattttatttcacaaatgccaagtatttgtgaaataaaatgattggatgggctgagctccacagccgactatgatctttaagattacctctacctctgatattctatgacattaaaaaaaaccttcatttccctaagaaaatttctatggtagagtaggaatagtaacacagcaatatccttcttaatgagctttcctcagtggaaggtcacttagagtttaatgggattaatttggctgacatgttcaattttaaaa

SEQ ID NO: 102008 - DNA, 750 bp, Homo sapiens
tgggattacaggcatgagctaccgtgccttgccggcattatataatgttcagaggaaccaggatcttttcatttaaaatggttctgattttatttgacaaatttgagtggactagaatctttaaatattttgcaacgtctttctagttactgttttcaaaaattagcttatttttcttattgattagtgtaagaatgacataatggtttgagaaatgaccataagtccaccaaaagttttccctgtgagtactgaagcataaaaagtaaaacctaaagaagaaatctggcatctttagaaatcttgctggtgctaaagagagaggaaataattttttatacagaaggcatgtctcaagtgaaaccaaaacaccaaagcacattccttcagtgtatattcacatggggtaaatatgatgctgagtaatgtgcacaaaggaaactcttgacaaaaacacagtcatcttttgagtatgttaggtcatttgttatttcatttgaaaataacctggctggggcgtggtggctcacgcctgtgatcacagcattttgggaggccaaggtgggtggatcacctgaggtcaggagttcagaccagcctgggcaatgtggtgaaaccccatctctactaaaaatacaaaaattagctgggtgtggtggtgggtgcctgtaatcccagctacttgggaggccaaggcatgagaatcacttgaacctggcaggtggaagttgcagtgcactgagattgggc

SEQ ID NO: 102009 - DNA, 307 bp, Homo sapiens
ctgcctgagggactgctatctgtcttgcctgactcagtactgatgggaacagctgcatcatttggatatcaggttggaagctgcggaaacaggtggttggtaccactgaatgtgagaggtgtagtgagtccacagaactgcaggaacctggtggcaaaaaattatgggcagaggaataaaatacagcatctaaatctctgagaagaagtagtgagatttttaggtaattaggacatttaaaagaagccgtgtgtatggaaaactggaattaaaacacacaggcccaggaaagacacaaccccagaaa

SEQ ID NO: 102010 - DNA, 677 bp, Homo sapiens
gtggcaggcacctgtagtcccagctacttgggagcctgaggcagaagaatcacttgaacccgggaggcggaggttgcagtgagcctagatcacgccactgcatttcagcctggtgacagagccagacatcatcaaaaagaaggccgatttcatgtggtttttcctggctgtcggtgagtccacagctaagaaaacactaattcagtacaacctaaagtgtaatctgctagtatcttttacagctggtggtggtaaaaatatgtgtacagcggaagaataattggacaaatttacaaaacttgtgaaaatgtaaggtggtttattcattgtgttattcatcagcaggtactttgcagaaaatatcttaatttatcatgtgttattgaactcttagcatcagtaattttacttggttttgtgaatcatcatcagttccataagtttttgtcagaaatagaagctgaatattctgatgtgccctgccgcgcagtagtttgatggcttagcagtggtagttttctttcaactttttgagctcagggctgagattgaaaattttctgaatgaggagaatcgctcccaaccactattgaatgctgaatggctttggaaattagcttttgctgcagactaggtaatgtttgttaatgaattcaacctaaaactccaaagtaaaa

SEQ ID NO: 102011 - DNA, 331 bp, Homo sapiens
gagacagggtctcactctgttgcccaggctagagtgcaatggcatgatctcagctcactgcagcctcaacctcctggactcaggtgattctcccacttcagccttccagatagctgggataaattcttaaaggtaggatttgggactgcgagtgttaattcttcaagtgtaatttaagaggcatcccatacttgacaacctcatataataggtactaaaggtaaggtcccatgggagaagaggctgtgtcccatttatctctctgtatcatcacagaacataagcctggcacagagaagttaataacagcggacatatataggcaacacac

SEQ ID NO: 102012 - DNA, 257 bp, Homo sapiens
ccgagttccgccagtcggacgaggagaacgaggacccactggtgcccacatctgtggccgccctgaagtcccagctcacccctctgtcatccagccaggagtcctacctgccaccaccagcatacagccctcggttccagccccgcgggctggagggccccggtggcctggaaggtcggcttcaggccacaggccaggcccggccacctgccccccggcccttccaccatggccagtattatgggtacctcagcagc

SEQ ID NO: 102013 - DNA, 354 bp, Homo sapiens
ggctttaaaaaacaaagcttcaggagacgaagtaagatactcaaagtcacatggctaataggtggcagggctaggatttgaatgagactgactcaaaactataatgcttaacagttacacccaaatgaaatctttctgaataatagtttcttatataattatgcgaatgttgatatttagtgttgtttgaataagatatatgtaaaagcctgttgcaaattagaaagtagaccactatacccatgctcatttatgtaataaatattttaccatttcctatgtgccagaaattatgctgagtatgggagacaagacagatcctctgcagtcccaagtctgaagatgcaggcagta

SEQ ID NO: 102014 - DNA, 598 bp, Homo sapiens
acacacatgtaagttattagaggaaaatctttcagaatttgtatttctgcataagtattaccaggctaccaagtgctaactctcagatgtcaaatcttcaaactagcattgcattcatttgtaatttcttaactctcagtgttcggtagtgtagcagttacattagcagtgtaattaggcttataaaattcatattctaacagttgatatttcttctgtagtgatgcttatttataatttttataactaaaaatgtaacaaaagtcactagaacttggaaaatatccttttaaggttttttttattttgctttttttttttttctttgagacagagtctcactctgtcacctaggctgtagtgcagtggtgcgatctcagctcactgcaacctctgcctcctgggttcaagcaattctcatgtctcagccttgtaggtagctgcaattacaggcgtgtgctaacacgcttggctagtttttagtagagatggggtttcgccatgttgcccaggctggccttgaactcctggcctcaagtgatccacccacctcatcctcccaaagtgctgggattacaggcgtgagccactgtgcctg

SEQ ID NO: 102015 - DNA, 457 bp, Homo sapiens
agtgtgatatatcctttaggtctgctctaaggccacagccatgagaaaataggaaactttacattttaagatgctaggacagtggtccccaacctttttggcactagggatcagttttgtggaagacgatttttccacagatgggagcaggaggcgggggatggttttaggatgaaactgttccacgtcagatcatcaggcattagttagattctcatgaggagcatgcaacttagatccctcacatgcgcagttcacaacagggtttgcactcctgtgagaatctaatgtcaccattgatttgacaggaggcagagctcagctggtaatgctcactcactgttcacctcctgctgtgcaacctggttcctaacaagccatgggtcagtaccgccccaggggttggggacctctgtgctagaacgcaaaagcttttgagttcactaattggaaaaga

SEQ ID NO: 102016 - DNA, 147 bp, Homo sapiens
cttgacctcctgggcccaagtgctcctccccatctcagcctctcaggtcactgggaccacatgcacacaccagcaggcctagctaatttttattttttttgtagagacagggtctcaactatcttactcagactggtctcaaattcc

SEQ ID NO: 102017 - DNA, 1457 bp, Homo sapiens
agcatttcaaaagaaatcttttactgaatggtggacttaacgtcttcagtaaaccatgattttaaaagatgtgctgtcatccaggcatagtttttctatctatagagtctatagagcacaggcagagtacatttagcaaaattcttaaggaccctaggatttttggaattgtaaatgagcattggcttcaactttaagtcaccagctgcagtcctttgaagcttggaagccaggcattgattcccgttctacagctatgaaaatcctagatggcatcttctttgaatataaggctattttatgtacactgaaaatctgttgtttagtgtttagtgcatccatcttatctagatcttctggataacttacagcttcatcttgcacttttatgttatggagatggcttctttccttaaacctcatgagccaacctctgctaccttcccactgcagtttcccactgcagtttccctctgcggtttctctcagccttcgtagaatcgaagagagttagggcccgctctggattaggctttggcttaagggaatgttgtaactggtttgatcttttatccagaccatttaaacttactccatatctgctgtaaagctgttttgctttcttattcctgtgttcactggagtagtacttttagtttcttttaagaactttttctttgcattcgcaacttggctgtttggcacaagaggcctagcttttagtttgcctcagctgtcaacatgctgtcctcaataagcttaatcatttctaacttttgatgtaaagtgagagatgtacaactcttcctttcacttgaatacttagaggtcattatacggctagtgattggtttaatttcagtgttgctgtttcacgaaataggaaggcctgaggagagagaaaaggaaacagcagatgtgtggagcagtcagaacatacacatgtatccattaagttcactatattatatgggcatagttcatggtgcctccaaaacaatagtaacatcaaagatcactgattgagatcgctataacacaaataacagttaagaaaaagttcagaatattgggagaattaccagaatgcgacagaatacatgaagtgagcatatgctgttgggaaaatggagttgatacacttgctaggtgtgggattgctacaaaccttcgatttgtaaaaaatgcaatatatatgaagtatagtacaatgaagtacaataaaacagtgtatgcctgtagtattatctgactggatgtttactatctacagaaacatctgaattataccatttgatctttgctttaaattaagttggtgtcttaaccacttaggtctggttgccttcctctctatacaaatcggccctctatgtctgtgggttctgcatctgtgggttcaaccaattgtggatcgaaaacatatagaaaaaataaaatgtgtggttgcacctgta

SEQ ID NO: 102018 - DNA, 1531 bp, Homo sapiens
agcatttcaaaagaaatcttttactgaatggtggacttaacgtcttcagtaaaccatgattttaaaagatgtgctgtcatccaggcatagtttttctatctatagagtctatagagcacaggcagagtacatttagcaaaattcttaaggaccctaggatttttggaattgtaaatgagcattggcttcaactttaagtcaccagctgcagtcctttgaagcttggaagccaggcattgattcccgttctacagctatgaaaatcctagatggcatcttctttgaatataaggctattttatgtacactgaaaatctgttgtttagtgtttagtgcatccatcttatctagatcttctggataacttacagcttcatcttgcacttttatgttatggagatggcttctttccttaaacctcatgagccaacctctgctaccttcccactgcagtttcccactgcagtttccctctgcggtttctctcagccttcgtagaatcgaagagagttagggcccgctctggattaggctttggcttaagggaatgttgtaactggtttgatcttttatccagaccatttaaacttactccatatctgctgtaaagctgttttgctttcttattcctgtgttcactggagtagtacttttagtttcttttaagaactttttctttgcattcgcaacttggctgtttggcacaagaggcctagcttttagtttgcctcagctgtcaacatgctgtcctcaataagcttaatcatttctaacttttgatgtaaagtgagagatgtacaactcttcctttcacttgaatacttagaggtcattatacggctagtgattggtttaatttcagtgttgctgtttcacgaaataggaaggcctgaggagagagaaaaggaaacagcagatgtgtggagcagtcagaacatacacatgtatccattaagttcactatattatatgggcatagttcatggtgcctccaaaacaatagtaacatcaaagatcactgattgagatcgctataacacaaataacagttaagaaaaagttcagaatattgggagaattaccagaatgcgacagaatacatgaagtgagcatatgctgttgggaaaatggagttgatacacttgctaggtgtgggattgctacaaaccttcgatttgtaaaaaatgcaatatatatgaagtatagtacaatgaagtacaataaaacagtgtatgcctgtagtattatctgactggatgtttactatctacagaaacatctgaattataccatttgatctttgctttaaattaagttggtgtcttaaccacttaggtctggttgccttcctctctatacaaatcggccctctatgtctgtgggttctgcatctgtgggttcaaccaattgtggatcgaaaacatatagaaaaaataaaatgtgtggttgcacctgtactgaacatggtagactttttttttcttgtaattattccctaaacaataaagtataactatttatataaggttta

SEQ ID NO: 102019 - DNA, 486 bp, Homo sapiens
gacttaacgtcttcagtaaaccatgattttaaaagatgtgctgtcatccaggcatagtttttctatctatagagtctatagagcacaggcagagtacatttagcaaaattcttaaggaccctaggatttttggaattgtaaatgagcattggcttcaactttaagtcaccagctgcagtacccctaacaagatagcctgtcctttgaagcttggaagccaggcattgattcccgttctacagctatgaaaatcctagatggcatcttctttgaatataaggctattttatgtacactgaaaatctgttgtttagtgtttagtgcatccatcttatctagatcttctggataacttacagcttcatcttgcacttttatgttatggagatggcttctttccttaaacctcatgagccaacctctgctaccttcccactgcagtttcccactgcagtttccctctgcggtttctctcagccttcgtag

SEQ ID NO: 102020 - DNA, 830 bp, Homo sapiens
gttgcccaggctggagtgcagtagcatgatctcggctcaccagaacctctgcctcccaggttcaagcgattctcctgccttagcttcctgagtagctgggactacaggcacgtgccaccatgcccagctgatttttgtacttttagtagaaacggggtttcactatgttggctggtcttgaactcctgacatcaagtgatccgcccacctcggcctcccaaagtactggcattacaggcatgagccaccacgccaggctggtagcagtctttcctagaatgtggatgccttggaaaacaggggctctgccttgtttccctagaacctagaatggcatctggcacacagcagatgctacatctattgtaaatgaatgaatgaaagaagtgtccttgcagccacactggcagccgtaacatagtggttataaatctagactctggagtctcaagtgcaaatgtcattggcctctcctccagcctcctcaaggggcactcaatgactggaagcgccttgatatgactgtggttggactgacatgactgccagatggtgggacttggtctggagcagagactacttggaatggtagaggcaaaactcaacagcccctggagctgcgcttgtggtggagctggaccctgattttagctggaccttgtttttagagacagggtttccttctgcagtctcaatctcctagccttgattgatcctcctgccttggcctcccaaagtgctgggactacaggtgcatgcaaccacacctggctaattttcttctcttctttctttttttttttttttttttgatggagtcttggttctgt

SEQ ID NO: 102021 - DNA, 191 bp, Homo sapiens
tattctcaaataggaattttattttaaatagcctttgagcagtacctgggtgctgtcttgcatttgcctatgatagatttgcctggaattaacaataggtgtttagggagtgaggctcctgaggtgtttgtcctggcatgtacattcattcctgtggaggggtcctgtagccttggagctctttgaggctg

SEQ ID NO: 102022 - DNA, 212 bp, Homo sapiens
cataaacaaaaagcagttattatgagtaatatttcaaaataatcagtagcaatgatctttactcattttagaaagtaaaaaacatatttttcaaagccatttaagagattatcagaagtcaacagagttgccatactattttgttgttaaatggggatctcttttatctgagcacataatagtttggtcacaatacaaaagaaaaccccaag

SEQ ID NO: 102023 - DNA, 407 bp, Homo sapiens
gcttggcacaggcaatctcagggtacaacagatacaaggagcagaggaagaaaaggaattcactactctccagcacccaaagggtgcttcacatctcacaatgagcccacaagatagatattattattcccattgtgcagaaagtgaatatgaagcaaaggccaagcttccatgaatggacttaaaatactgtggctgcacacaggacctgtaatcccagctactcaggaatatcagatctgactgcgtgttctcacttcgctttctggaacttgctctcattttcctgggtgcatcaaacaaaatagaacacaaacaatccagttcccgcctctcactctgaactcctcccaagactcgtggggtgcggcagcccctgggaacacccagcccttcaaggtcaaaca

SEQ ID NO: 102024 - DNA, 500 bp, Homo sapiens
cttttatgcttttattttcttggacacattaaaatggagagactttaaataagatttggagagcctcttgaaataccacaatataacgacatatatttattgtttgacctatttccccctataatctgactcacttttaaattcttaacgcttcttaagtgacctttagtcactgtcagattgccttttaaaggagtttactgtatgataggaaagaaagtattaaaaatgaactagagcaatttggctacatactacgactcagatgagagatcctagacttcagggtcaatcagaattaatttcttttctaaaatggtatgaatttaatgccacctattgagaagtaagacgtatgtgtggaaaagaggactgtgatgaaagtaaaacataatctagggccagacatggtggctcagacctgtaatcacagcagtttgggaggtcaagttgggaggatcaatagaacccaggaaattgagaccagcctgggcaacatg

SEQ ID NO: 102025 - DNA, 186 bp, Homo sapiens
agagaacgagaactgagaaagtggagacagtgcctctaaacagcactttaaagacatgttgtatggaaaaaaacaagattgtaacaggagggagaaggtcagggaagagttttttttggctttggttgacttggtttttaagatgcaagattccggcacctttgtatgcctttggagttagagaga

SEQ ID NO: 102026 - DNA, 854 bp, Homo sapiens
gatctcactgtgttgccaaggctggtctcaaactcctggcctcaagcgatcctcccacgttggcctcccaaagtgttgggattacaggtgtaagtcactgcacctggccagttattttattttcaaacattttcttaagaaactcctatattatttctattaaaatattttgactgtttaaaataaaacactgattaaatattttaacatttaccatttaatttaaaatttggaaagtactcttggagcctgcaaatgaggcggttaaaaacatgaagaacccttctaacttgcactagtgcttctgcgtctgttcagaatcgcactggagcttatccagcagttcataaacccacaaaactctgtcttcgcaaatagaggacactatgtgttaagaagcataaggcctcaaaaatacataccacacagcttcacagaggcacgcaaaccaaaggaaatgcacaattggaagccacattttttggaatgtaataaaaggttgtttagtgaatgtttctaagcctctcagctgagtaggtagcacactccccgcagaggtgaggccttctgacgccatcacagggttcaacgctggtatctcctcagggcttcagtcactgggctagggcagacatctgtgctcctgcacctgtaaagatggcaaggcagtaggtgctgcagaattttaggggttgtcagggagatgcttttgaaatcattatagctttgggaggccaaggcgggcggatcacgagttcaggagttcgagaccaacctggccaacatggtgaaatcccgtctctactaaagagacaaaaaatcagccgggggtcattgtgggcacctgttgatcc

SEQ ID NO: 102027 - DNA, 858 bp, Homo sapiens
gaatcctctattttgaaaaaaaaatcagatgcatcaaatgactcttctgtgaacaactgtttgagaacgatactaatgtcacacataggaatactacattttctaggatttgacattttcagtgatcgagaattactacattttgtaaatgaaaataccactactaaaaacagaatgatatacatagaatgatgtcttttgtttccaaagtcgatatactacagcaatgcagaaacaatcatgaaagcaacattattttgtggcaaagttgtcttaaggtaaacactgcagccacaagcaccactggtgagtattctcagtgcagacaggaaagagttaaagcaataggtcttccaggctttgctgagcagctctctgtggaatgggatatgacttcaatacctgttcaggcagttacaactctgccttagccttcgcttcttgcttttggcctgaatctctctcctttgtgactctgctcagctgtgacaaagggatgtggccactgcacaccccactgtgacccacctgcacaggtgcatgtctgtgccgtttgcctgggtggccttcactctgatccagagcagcatgcaaggacattgtcctggccaagaggtcatgggcgagacttctctgagctcttggagagtttggtctctttgctgagatccataacattttgcaggtatttctcaccgcctttcacactttgcccagataccattgtgttggacacttttcatcacaatccaaggtttatggttacggttgtctctggtctcattggatgtgctttttttcctctttatgttttattccttttgttgtttgtatttggctttacttggaaatggaata

SEQ ID NO: 102028 - DNA, 451 bp, Homo sapiens
gttttcacttgtctgtattgtctaaattatttttgtaataaactatttttaaagtgcctttgtgcagatgagatacacaggaatatgttactgtttctgagggaaactatctgagcatttaacttattctcatgatttccataccaataagtctattgttgttaccaaacacatatatcaaagccatgtctaaaagagttagcacccttctgagaaaaaaagcaaattcttaaaatcaaaatgcaaacacttcagttcacagcttactaacccaagaaaccatcttacaagagaacagatgtgattagtgaaataaattgtttaagttacggggaaaaacatagtcgctggaagtttaagtagggacatgttccagcagttaactgaaatataactgatgtcccatctctccatttctctctataaataagtctttaccctgactctctcc

SEQ ID NO: 102029 - DNA, 445 bp, Homo sapiens
gacccttctcatgtatttccttaacttccttagagaagtgacataggctacccaggaggcagcagggacatcctttactgttgactgaaatggtgatgaatctgccatgggagtggaccataacctggctccatgtccggatttaaccctgtctctagttaatccctgctggagcccctgttcacacagtctgatttcctgggctctcagctgtcccccaaggggtgttcctccctcccggtctcattcaagctgaccctgtgctgggaactcagccccttgccctcctctatcctcctcatcctttggatttgggacctggttctgctgccccgtgaggccatccctgatggcttctcttctccctgagttctcgtccttcatcctgccttcctgtgccgtgcaggacgtgccttttcttgggtccactgccacacgcctttct

SEQ ID NO: 102030 - DNA, 907 bp, Homo sapiens
ggaatcagagaggtaaaaaatgccatgcctgagcgttagtgccggctgacacttggccttagcacttgggagacataggaatagttggaagcatctatggggcctgggctttgcctcccattggctaaatggttagtatacacaatctcatcagatctttataaacaactctgtaggatgaatattttatttccattaaaaagatgagaaaattgaagctttgctagatgtcagtaattggtgcaagggggcagggttgttaaggtagagcagaatacctgtttcaaagaccattcctttcggggagagcatggtatttgtccttcatgaaatctgccttaaagttcaggaagttgcctgcaacttcttgacttccccttaacaactgactgtgaatctgtcacttaaatattgttctaaatgtgtctttagcttgtgttttcagtaactgtggcccacagtttcttaatgagagtctgataataaacaagttaaacaatgaaaaagggttctctccttagggcccttgcctgagcttgtttctatttcctctgggaggaaaaaagaaagagatgtgtcagaacagaggtggaacttctcagagattgagagatccgtctactgtaacttagtcatcaccatcaattttgttacctgaggcaggcagagctgctacctcccacagcctgtggttatcctcacaacagagttactaagcacggagccctccaggcccctgccaagcgcaccctgcatgtgccttacgcaaggtgtccctgagcattgaatgttgggtggggtgggggttgcccaaggttatagcaataaagaaaaaacatagtgccaggtgcttctctgaaatcatttaccccttcttttgtagttaggttttggctttcaaaagaca

SEQ ID NO: 102031 - DNA, 317 bp, Homo sapiens
gaatctgtacagtggtgcagtgttaagggcaaagagcactttggagccaaggcagacaaaactgcgcagagctcccaggcctgggtgatgatccctcttcccagacatctgaggagttgccatattgatgttctctcattgtttcggctgagctggaatgatcgaaataattctgggactatgacaagtctcaccagacctcgttatggatcagggagaggtgaactttaaaaataatcaagttcaaaggagagccctgtcacctgtgatcagtttcgttagcagaatcccaccagccttgctccccatatccaaaa

SEQ ID NO: 102032 - DNA, 264 bp, Homo sapiens
agaacgagaatgttaatcccaggcagcctcgctgacttctccccgcctgctccagcccaggggctgggtttccaagatgatccgccccctccccctttccctcaagtgacagtgcagcagtgactttgttctctcttaacctccagagaagctgcgggaggaccccatctccgcttttccacctatcttcctagctttgcggccttcgaagctggtggatttattgctaccgtgatggttgcttagcagtaccttcctctccca

SEQ ID NO: 102033 - DNA, 432 bp, Homo sapiens
agtgtgccaattgtgcaaatataatgtaattcataccttatttaggtcacaagcctattctgtcaatccagaagaaagaacagctcctgaccaaattgtttttcaagaattgtttgtcttacctgaaatgtctcagcattgaaactactctcggcctatcatgttcaattaagctaaggatttaaaagttaaaattgaactctattcagcagattacatcagtgcagttgtattcttgtccagtctgaggtccagagtccccaaaagctggctgcttacatgttgtgccctggtaccttccatggaagtggggagactgctaaacgcagtgctcaaaaagtcttattatgcttcccgctgaatggcatgggtccaacttgtagaagtgtttttagtcatccatgctgcattaatgattcagagagcctttag

SEQ ID NO: 102034 - DNA, 396 bp, Homo sapiens
tttggttataggaccttttcaaatgggttacgtaggttgtatattctttgacacccatcatgacaaaactattaatacctttctttctgaaatgtgagtcatattttgcctagctttctgactcatatcagagttcttttctctccgacatatagaagttattctacagttttctaagttctggttttgcaaatgagaattcaacttactttccattgtaaactttacatttctcattctggaagagcatttgattttcagtttatccttgaaagtaaaaaatttgaaaaggatacgtcttgttgtatgtgtgtgttcctattaatcacactcagtgagccctgtaagtctagaggactcaaatctagtgattgtaatatgggagcaaaatgatgt

SEQ ID NO: 102035 - DNA, 236 bp, Homo sapiens
agaaaatgagagaaaaaaatggatggaaaagacagaaaagagtataacaatcatctgagatatggtgaaaaggttcactgtacacgtaattggaatcccagaaggagaaagaatggggcagacgtagtgtttaaagagatagtatccaagatagtccaagagtctcccaaaacgaatgaaaaacatcaagagcagggggaaaacagaataaaatggaacctttttttctttttttt

SEQ ID NO: 102036 - DNA, 170 bp, Homo sapiens
gtgtgtcctgtatctttagatagggtggatgggagtagcttctcagatgcagtgccatttaagcagagacatgaagtgagagcacacagatggccagaaaggaggccccctgcatgcagtagagaggtgagcacaagccgagaagccacaggaacccaaaagaggggtgg

SEQ ID NO: 102037 - DNA, 363 bp, Homo sapiens
agtctcagtgtggaaacggtggcacttgccctggctgggtttgactgtgtgagttttgtgttttgtaattagaagggaggtgtgcctctgctttatggacaatgcctggcaaatgctgccctccctatttttgtcgcatctgcaagtgtggtatgcatcttgtaaacaggtcactaattccaggctaggggctggaaggcagctataatctcgctcacgtggtttcacccgctccatgtgcgctggatgccgacagcacgaggggaagcctccggagccccactcctcctcggctgctccacacactggaaactgcatctgacagaaagattaaacgtctgcattttatcacctttgttgaac

SEQ ID NO: 102038 - DNA, 146 bp, Homo sapiens
tttgtttattaataatgaaattggtgctgacatgtaatgacttcacaagttttacgagggaaaactgaaaaaggaagtaatataaattttgtggggtttttttgagatggagtcttactcttttgccaggctagagtggtgttgca

SEQ ID NO: 102039 - DNA, 363 bp, Homo sapiens
cttaaaatttctgggaggcctctacaactaaacagcccacaatcgttaaatgtatattacttgtagaaggcacaggtgtggaatataagaacagggcagtttaagagcacccctcctctatgtggtttcagtttacgcaggaagataaggccaggctctgtttgtttttgaacctgaaaccggacagggcagtcagtggcaacagcagatgggctatgtggacagctcaggtattggaagatctcactaagggcaggtggggagggaggcttccaccaaaggggagatttgacctaactcccgaaaggtgggaggcctcagaccagaggtctgccatggcctcctcccactcccttacaatct

SEQ ID NO: 102040 - DNA, 431 bp, Homo sapiens
tgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatag

SEQ ID NO: 102041 - DNA, 1548 bp, Homo sapiens
tccaccttagaccaaagagtcactagcactttctacacattgcaaatattcagtaaggatttatttctcatgctttacttgtatcaattaacttgatcctcacaacaatactgtgtgaggtaggtgaaaaactggaggcatagagatatggagtcaattgcctgagtgaaataactggggtatcaatcaagggctcaaacccagaaggtcttcttccaggacccctctcttaatcactattcaagcaactctcccaacagtgattttccacacttttttgatatatataccatggattcttaaattttttttctctttaaaaattgttccttccttttgaaattcatcctcacttttataattttagcttgtcaatattagtatgacacatttgggaaacttgctttataatgctccaaattctgaggagtaactattctatctagggatgtggtctgtattttaaatatgcatgcagtttggagctagactgagagagtagtcaagagcaaaggggagtccagagactaattcctcttttgggtttctcacaggctacatggcttctcactgagatatctctcccactctttgcaagtctctgcataaccttccttgcatatgggactttaaggttgccaccacctctctccacatagtaacctgttacacttatttctcagtgtgcagcacctcattgtctaggttatttcttagatcaggtttctgaaggatggaaaatctaattatgttttattagtttgagccacactacttatagatcactgcttaacctatgttgtctgtccttagttcttatgcctgccctggttcagagaatcaaacccagaggtaaagctggggctggggttccttatgcaaagagagctgtctctttagtaggaactctggattggctcattttgctttaaagaagttatgggcaggaggagagtaactgagaaactgtaattgagatataattaaaataagataaaattgatcaaataagcagaaaaagtgggagaattgaatggctgagtagaagtaatttttcagcgttggaagagatctctgaggcatgataacgccagcagtggtgctatattctggcacattagggagaagggttttgagatgtgagtgaaggtattgaccatatcctgctaagtaatgctgtgactgattgacaatatcgtggttgaatctaaagctagatgaccctgtcagtagggaggcaatagtggggagaaacatttctgccctagaaagatttcctgtctattctaccaagttactctgtgttgctcaaagtaggataattccaggtgaccaggtcatatgaaattatatgttaaagaatttgaattttaatggcataaaatgctagattatattatgtacataacacttttatctacactgtaaaaataaaggtatttgataatatttatcagtgtttgattcttcaaggaggggcctagctgccatggctaatgcctgtaatctccgcactttagtagactgaagtgggtggatcgcttgagg

SEQ ID NO: 102042 - DNA, 402 bp, Homo sapiens
ttttttttttttaaaaagagacagggtctcattctgtcacccaggcttgagtgcagtggcacaattataactcactgtagccttgaactcctaggctcaagggatcttcctacctcagctttcagagtagtggcactacaggtatgtactaccatatctggctaattttaaaaactttttttttaagagacgggagcttactttattcctcaggctgatcttgacctcctggtctcaagtgagcttcttacttcagcctcccaagtaatgtcttagttacctattgcagcataacaaatcacctcaatgtatgcattttttttaattgaaaacaaattttttaatttttgtgggtgcatggtgtatatatggggtacatgagaagttttgatacggtcatgc

SEQ ID NO: 102043 - DNA, 413 bp, Homo sapiens
ctcctgatttgaaagtaggtatcttgcaataccaatttgaaaggtatgttttgccttgtctgcagctgaaatttattggagacagtgaaatgtgttcctaaatattgctgccactgagaacacaaaaatcgaataagatgtttactgtatggttgatattgaacctaaaatgggaagtggcccaccacataatgtcaatcagtattatatggacattatccaaactcagaaattttggttgcattaattctagttaacaattaaggccgagtgcagtggctcacgcctgtattcccaatactttgggtggctgaggcaggaagattacttgagcccaggagttggagtctgcagtgagccatgatcacaccactgtactgcagcctgggctacagggcaagacagcatctctt

SEQ ID NO: 102044 - DNA, 296 bp, Homo sapiens
tctgttgtggagatgtgtcagaaatgtttggtacataacaagtatccaataaatgctacttaattttaaattatctctcaaatatgtcccttctctccaataggatccatccatccgtccaagtaaatattttttgagtgcctgctcctgcctaccatcatgctagtggcagtctagctcatggcagcaaatctagggccagcactattcctacagcctcccatctggcttctccatcttcagtttctccagagactacatagcctctgggctccacattttaatatcattgttaa

SEQ ID NO: 102045 - DNA, 467 bp, Homo sapiens
agacaggacagtgcttggctatgagccatcggtcttggtgtggtagatggcatacgtagagaacaagccgtgaccagcatgtcctcttgttcccttcttgcctggtagcttcctgatgtatcatccaggttgaactttattccccttttttcaccagctttgctcttcctcttggccctgctctgcatccattgggaccacttacttcccatccccacttcgctagctccagtccacagctgctgtagcagaggatgctaatggcccaggcttactgtatggggtagcggttgggggtggcctgggctggggccagccagctttcgggcatagagagggtgggggaattcgagtgtccaaccaggacaggaagggaaatgctgagctctgagatctcctcccttttccacccccagctgcctctgtttcctccctcattcccctgtactcctgcctggcttcctgcc

SEQ ID NO: 102046 - DNA, 324 bp, Homo sapiens
tcctcctactgatgtctttcagtagattcagaagtgattgtggcaaacatagtatcttgaaggaagagatcgtgttttgattagcatctcccgagcctagttttgtgtttatgttcatggtattgaggaaataaagatcaatttggacttcttgcacctgttaatacatcctagttcctgactgcagcaaaatgactctcagtgccccttctcttcttagtgattgcctaagatgacagcttcattccctttattattatccaccttcttcccatcttcattgttttctcagtgaggactggactctactggactccactggag

SEQ ID NO: 102047 - DNA, 287 bp, Homo sapiens
ctcaggaggctaaggcaggagaatcacttgaacccgggaggcggaggttccagtgagctgagatcgagccactgcactccagcctgggtgacagagtgagacgccttctcaaaaaaaaaaaaaaaaaaagatatttcttagacaaacagcactataataaatcattgctgcatatgtgttcaatattggtcttcccaaataatacttcatactttctttcttgtattatagtatcacccataatgattcctttaatttagcatttatttactttccttttttttttc

SEQ ID NO: 102048 - DNA, 390 bp, Homo sapiens
caagactagcatgtgaaatattcagtgactaccatccttcaatatactttaacgccaaaactatctggggagacagtaatcccagcactttgggagcctgaggtgggcagatcatctgaagtcaggggttcgaggccagcttggccaacatggtgaaaccctgtctctactaaaagtacaaaaattagccgggtgtggtggtgcaaacctgtaatcccagctactcgggaggctgaggcaggagaatcgcttgaatctgggaggtggaagttgcagtgagccaagattgtgccactgaactccagcctgggtgacaaggaagactctgtctcaaagtaagcctgaccaagaatgatggtgattgtccccactcccaaccccaatctattc

SEQ ID NO: 102049 - DNA, 426 bp, Homo sapiens
ttagctccctggagttctcttggttagaaagttgagtcccattgtttcttggagttaccttccagtgaagagagcctccctatcccacttgactctgaacttgctgagttcagggtccatgttgtctttggctttgtttattttgtgcacctggcacagccctgcagagtaggtgctcagcaaatgttgctgacctatcagaaacacagtctactgtgggaggtgctaatcaaacaatcatggtgcaaggtgctatgggtaacatctgtgttcagcagagtgggtaaagtctaggatggaggtggggttggggaagcattgggaagccctgcctagagtggccgtgagattagttgctgtagactctcttaatttgagaaccctctatcatggggcaagagactctgatgattccctgttgcattt

SEQ ID NO: 102050 - DNA, 154 bp, Homo sapiens
  misc_feature (63)..(63): n is a, c, g, or t
  misc_feature (77)..(77): n is a, c, g, or t
  misc_feature (91)..(91): n is a, c, g, or t
gctgggaaggcccggcggggaaggtggctcggggggccccgtccgtccgtccgtccgtccgcntttaactacatctntttggttggaccanatttcccctccgtggaacactgaagaaagtggatgagttgttttcgaatatgtataaagtaaa

SEQ ID NO: 102051 - DNA, 523 bp, Homo sapiens
actttacaaatgctgaaaccaccctccactcacgctgcgttgtttcagcatttgtaaagttaggaagacttttgccgattaaaggacaaggtcagcctcacgattctgacttaaaatgtgaaactgagcacgtggcttagacttgagacttgaagctgcgctctgagaaactttggaaacagtgctggaattcaccacatctgtaattcaatgtgttagacgcacaaaagatgtgcttcagtctgtagcgaggctggtttctcagttgggccgtggaagtacttacaaaggaaactgaatcgattaagtttatttatgcagttcaaaatgtttcaaggagctccatgaactggttttgtaaatgggaccaaacagtaaggaaatggtccttagaagggattgttctgatgtgctggattttaaatagaataagtaacatgtgtaaagtgaacttaaaagcttaagaaagaagaacatttttgaatgcgtaacattcatgaaacaaatgttaatgtttaaaatc

SEQ ID NO: 102052 - DNA, 289 bp, Homo sapiens
  misc_feature (167)..(167): n is a, c, g, or t
  misc_feature (254)..(254): n is a, c, g, or t
ctatgatggctttaaataattttacaattaaaattgggtttattacatgttgaaattgaagggacaatataagcccatcacttacttttctcctgattgtcaagtacattctatttatgacttttaaagctggagttaagattattactaaactggccatgagccancccccctggcctatttgtagttttaaatcagtattaacagaagccaaatgtgtaagtaaagtcagccatgaatagaaaagttcattnaaaatccatttcatagcttcttggcgttcagtgta

SEQ ID NO: 102053 - DNA, 575 bp, Homo sapiens
gtgtttggcggggtctggttttatttactgtatattcgggaagtatgtgtagttagggaagtaaaaacttggaagttactttgggttttgtgagaatgtttgattcattatacatatttgttaaaagtttactttgaaacttcaactttgagaatagacaaatttcttgacgtcctgtaaattcagtggtattatatagcattttaaaatttatcacttaggtgcaattacagtgtgaggggaaaagttaacttttttgaatagttacattgcagtgacagcaagagagtatttttatgtgtagacaggctgtgggttcccctcacttaaattgaagctctgttgaacttgagacacttaagaatcttgcaagtgtgaaaagtggagtgaaacaaaaccatttctaaaacgaaaatgtgtaactgcgttcagttttacacagtgaagaaataagtattaaacaagttagtctcaaacgtttatatcttaaggtcattttattcctgttatcattaactagacatatcttggtttagagagcagcacacaagacattgtgtacttttaatagctaa

SEQ ID NO: 102054 - DNA, 159 bp, Homo sapiens
ctcctaaccagaaacacagattcaacagtaaaaggtgaaaacatcactggcttaaattaaaaggcttagctaggtacaacctccgaccaatcactgactgaccgctggagttgacaaggacaagaaacaaaatggaaactgccatagaggggctcaaca

SEQ ID NO: 102055 - DNA, 509 bp, Homo sapiens
agaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggaga

SEQ ID NO: 102056 - DNA, 445 bp, Homo sapiens
aaaacaaacaaaaaaacctgtctcttaaaaaaacaaaacaaacaaaacaaaaacctgtaatcctaagtgtagcactgtcctgagttctgtgagttgttctaatgaattactgaacctgaggtcatgagaacccccatacacagagtctgttggttagcagtgcacaagtgaggccggacatggtggctcacgcctgtaatcccagcaatttgggaggccaaggcgggaggatcacttgaagtcaggagtttgagaccagcctggacaacacgggaaacctcacccggcccggacacggacaggattgacagatggctacgctctttctcgattccgggggtggtggtgcctggccgtacttagtgggcggacgcgattggtctggtcacttccgataacgaacgagactctggcatgctacctagttacgcgacccccgagcggt

SEQ ID NO: 102057 - DNA, 626 bp, Homo sapiens
  misc_feature (1)..(1): n is a, c, g, or t
ncttatcagaaaccccttatgtaaattgcctgtttagcgggccatttacggatgctttgcaattagccaaaccactcgtttgtgtctagatggatacaactcagatacagaagggtagacactgcaggaatccatttatgtgaagttccaaaataagcaaaaactatctgtggtgaaaaatcaggaatagcaatggcctgggtgagggaggttaatgtgggtggactggataaggaaatgagagaacttccagaatgtggtggtaaggttctgaattgtgatatggctttgtgttacacatataaaaacatttgtcaaaactcttcaactgaaacatttggtgcattttattctgtggctttacttacataaatgtaaacaccttttagactgtatgtaatgatatgcaagttgaattatgtaggggttgtgtgatgattttttgaaattcaagaaaatataagggattaacgtatgaataaacatatgacaaaatagcacaaaatgttaattgtggaacccaactagttgtttgctttaaagtctttcaacacttttgtatgtgtcagaaaaagtatgcagtagaaaggacttaaggttaaaaataataaagggaatgtcctgaa

SEQ ID NO: 102058 - DNA, 340 bp, Homo sapiens
ctgcccaggcctcttgctcatagaataattcttaatgttcacttggcagtaacgatttctcacttcccaatccgacagtgaagtacatactcacaatgagaaaagaaaattggtgctacttttagaataatcaggtctgtctttcttatacataatgtacttacggatatacaagttattatttccagcgtatactgtgtaagaatgaagatttcactttagtagatagtaatgaagtataaatatcttgaagtttctcagtgaaacttatcaaaaacagtacagtttttatgatacaggcactgtctctgaaaacatggaaagtgacctaattacagta

SEQ ID NO: 102059 - DNA, 376 bp, Homo sapiens
agagtaatcacccttaaccatcacttctcccactgaaagggagaatagacagaagccaactatctaccctttttctacataaaacctcttatcgagcctccagttaataaaataatagttctgaaaccccaaaaaatattagcaattgttgaaatcatgctagtttgaaaatagttgagttttcctaacaaaatatgtctcaggatcccagggtcaccaagcttatattaatatagtctagttgggactaatggtaatcatcagtgaactagtcattttttagcttcttgggctcttaaaaaatttgttatcattaagcccacacttcatagagtcacagctattttatttttataggagactcaacagtcaaagt

SEQ ID NO: 102060 - DNA, 549 bp, Homo sapiens
aaacccaaaaaataaaataaaattattttttatttttgtagagacagggtctcactatgttgcccaggctggtcttgaactcctgggctcaagtgatcctcccgccttggcctttcaaagtgttgggattacaggcatgagccactgcgcccagctcctcacctcatttctgtgtcttttttctcaagaaacttagctagggggaaggaattgcccacagaaattttggtttgtatttcttttcttctggcacttcagaaagcaaggatactgcagtttagacctactattttagcttatataggactctttgcttttgtcatcttgtccatcactagttttcaaattgccatgaggaaaggcttcatgtgggaatgagattgtaacttttttttttttttttgagacagagtctcgctctgttgcccaggctggagtgcagtggcatgatcttggctcactgcaacctccgcctcccaggttccagtgattctcctgcctcagcctcccgagtagctgggactgcaggtgcatgccaccacgcctggc

SEQ ID NO: 102061 - DNA, 350 bp, Homo sapiens
agtgatctagaggatgctttttgcgttcctttccactgctgcctcctgccttcccaggggacaccaggcctgaccaaagagacttggagcctggttgtgagatggagttccccggggaacattcagctgatggccttctgcccggcaggaatgagacaaagggggccagggaccctgggagccctgttcacacgctccagagagtctgcgtggaaattccaggagggtcacaggaaagcttcagatttagaaccacagtgctttatttttttccccttttctcttctgttccatcctttccctcatggtcggtgggggtgtcatagaagtctgggaaaggaaagcaagca

SEQ ID NO: 102062 - DNA, 623 bp, Homo sapiens
tactcagcagaaccagggaagtctgaaagatcactggtccgcaccaatgtcaatatcccaggtatgagattagactgtagttttacaagatgctattgtcaagagaagctgggtagagagtgcacaggccctttctatattatttcttacaaccacatgtgaatctacaattatgtcaaagtaaaaacgtttaaaagggagaaggggacagacgtctttgccgcggtaggactggctgggcctggggctgggaatgaagaatgaactccccagggcactggtggccagccaggactgagaaccgtcatccacagcactgaccccccgaccccccacagccatgtctgtctcctctcctcccgtggtgggggctgagaggcagcagcttcccgggaatgccttgagtaaagcaagcacggtgcccctcagctgtttctaactcactcgggtgaatgactcccttcatctacaccacctggcttcttaaaggagcttccaaacattttaaccatcacacaaatcaaaacgcaggcagagcagtctcctccacagtgaccctccttgcttaattaaaccacatctaacaagtgatctggacaggcggtgctgtgctgcttccccga

SEQ ID NO: 102063 - DNA, 391 bp, Homo sapiens
ctcacttaacctcctctcaagtgcctgactcagtctcacagggaaccagggtcagtttctgcaagagttcacacaaatccatcaccattactgaaaaggtcactcaaaggtcaggatctgtggagcagggttactggtatcgtctttaaccatgaaggacagtttactctatgacactaaagttcatctgtcagataaatccattcctcttgcaggcaagtgggtctctttggagtacttctattttacagttgctcagttcttatgggtaacccctcctttgctcaagggcaagtcagaaaggcttggaggggcccactgtattacaaagcacctgggaatgccctggaaatcattcaggaagcagtggttcagaaacatttagagagga

SEQ ID NO: 102064 - DNA, 750 bp, Homo sapiens
gcaaattgaaggaataaagtgaatgtattgatagaaaaccttcaatgtgactacagcttttttcacaattatcctttcttaaaaataaagtatttatattatgaaaatgcagccatttaaaattgatgtttggtgattggtaaagtcaaacagaaccaccaatgccttcaagtgtggctcagatgtcaaaatcaagtctacagaataagataaagaacaaggtccatggaattggaaagaacattaccaaagacggtctgcttctttaatcttaactggttttgaaccataatattccaatctatttacagctcctccagctgctcaagaaccaagttcaaacttctctttgttgcactcgaaaagatctcttgaaccaacacacaataagcttgactgagcctgcttcttgagaacttgtatggactagactgtataagccacttaatttaatcttcataatgtaagaaaatcgttttgttatcatggtataaaaaatgtcctagtttataaaaccagggctccaaaatcagtttaatttgtatatggtgaactaataaatggatgtacttggagtttagcagggtaggtatcaccacggagggaaaataaagtaactttctcagcacttaacaggtatttgcatttaattaatttttattataagtaatacacaaatatattcctaagaaaattcaaaccttatagataatgcaaaaaaggaccttttgatcatcattcctaatccca

SEQ ID NO: 102065 - DNA, 129 bp, Homo sapiens
tctaggttggtaaaaaatgagatgccgtacctcctctggaccatcaagagggacatcattgactatcacagcctgacctacgaccagatgctgaaccactacgcaaagacagcctccttcaccaccaag

SEQ ID NO: 102066 - DNA, 388 bp, Homo sapiens
attgcacatgtttcctcctcatccgggattggcttcatcctcagcccacgtgagatgacagtgaggcaggcagcactcgtgcctcccagtcctcagctttgagtgcaccaaggaggaggaactgcggtctcagcacacttcccggccccgccttgcccaattgggtgctgagtctggcttccaaccaatcacaggaccaggggaacacttgccgaagattggattggatttcacgcaaatcatgggtagagaatagaggaggagtgggttcccagaggaaattctgggcgctgttttaccagatgggcgataccccctactctgttgtagggaggcaggagagggaacactgggctgagaggcgacctggattccatttctggtttag

SEQ ID NO: 102067 - DNA, 382 bp, Homo sapiens
tctgtttcatgccaggtgaggtcaagtactgagaatacagtggtgaataaaagaaacaaaatctctaatttccaggagcttatattgaaaatgagattgaacacatacaaaaaaaataataacaataatgaatactatatttacaaataatagctgtaagaaattttagtacctgttttaaattagaaaaatataaaaattattaaaactaaaatggccagatgtgatggctcacacctgtaatcccaacactttgggatgccaaggtgtgacaatcaactgagcccaagtgtttgaaactagtctgggcaccataggaagaccctgtctacaaaaaataaaaaattagctgggcatggtggtgcatgccgtaatcccagca

SEQ ID NO: 102068 - DNA, 658 bp, Homo sapiens
gaggcatttgtagtgccgctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttattatttgcattttcatgcttttattttctccttccattcataagtatatacttgaaagtacatctgtagcctatgatttgagtctattgaagttctaggaagaggcaaactacaaactactaggattctgatttcagatgtagtcattccagaaccttctctttatgagttcacctgctagtacaatctccacaacttgaatggcattggttgttctataattcctgccacaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcc

SEQ ID NO: 102069 - DNA, 398 bp, Homo sapiens
atggaaccagcaacagtgaacatttctgaagcctttgcaagtatagaaagtgcttagaacgttcctttttcttcaagcagatgttcctcttgaggtgcatacccaattaaatgatatagatgaacattcagcgactactgcaacacaaagtattttgaaaagccaagttcctagttttctccttaactacgaagttgtgaaaatattgattttataaagtctataaaatagtaagcttaatgaatacttatactggccaggtgtggtataagtatacaggcatgggatcatgcctgtaatcccagcactttgggaggcagaagcaggtttgctttgttgccaggagtttgagaccagcctgggcaacatggcgagaccccgtccctaccaaaaaaaaa

SEQ ID NO: 102070 - DNA, 360 bp, Homo sapiens
gctgccgcctactactactaaattcacccccgctcgacaaaagagaattttatttagtaacaagacgcaaatccccagtggcacttggcacagccacctcccctgaagccccaaaagcctatagtgggggcaaatgatataggacagtttcttaagacttaaaaggcaaagtggcatctcgaacctgcatggctgttaggtggttctagctgtggccgtccagcccaaggggagtctagcaccactgctaaggaggattgcgaggtgtttcttgctgatggtgaagagttggttcgtggaggtcacaatcaacctttatccaccatccagatcccagagccactggggattttcaacttg

SEQ ID NO: 102071 - DNA, 495 bp, Homo sapiens
agtcaggtccgaagcaaaaggaatacacagaagaagatgattatgagtgttttgaaaacctgccccttcctgcccgcccgggacaatatttacaaagcagacatgcaaacaagcagaccttcttttcaggtttaaattgcctactgagccaggcggttcccgtgctggggtgcttgcccagcactaagttaggtgtttaaaaaacgcatttgccagccagctgcctgccttccctttggtggttaccgtgtggttaggaagctcaggagtagtgttgttcttacctgagtaagatacagactctttttaagggaaaacattcccaaggatgtctactgttgaattaattaactttattattatgttatttaaatatatacaaacataaaactaggtataaattcctcagcttatagttcttacacatctataaatctaaaacaaatttacaaatgatatgcaaacaaaactctaacatgaatcaaatttaaattg

SEQ ID NO: 102072 - DNA, 423 bp, Homo sapiens
ccccaaaatgcagttcattcacagatcactaacccggggctatccctgcaagttaacaacccctggttacttttatttattttcttccttgacaagaaggattaaaccttcccttctcttcctaacacccagcacacagctggactaggcaaaattcttaaattagagtgtggattttaagaggctgaggcaggaagatggcttgagaccaggaatttgagacaagcctaagcaagaccctgtctttacagaaaatacaaaaattagctgggtgtagtgccgtgcacctgtagtctcacctacttgggaagctgatgtgttaggattgcttgaacttaggaagtctaggctgcagtgaaccgtgatcatgccactgctctccagtttgagcaataaaatgagatcctgtctcttaaaaaaaaa

SEQ ID NO: 102073 - DNA, 276 bp, Homo sapiens
taatagaaagagcacagcctttagaatcaggcagtacagagtccatgttatgtcttggtttcctcagagctgcaactattacacattattattccaccttagaaggtttgggtgaggacgaaatgagataatgagtgtaaagcatctatacatgtatagcatgctgccaaatacctcacagatattcagccagtgctggtatctttccctctccaggttacaaatatttcgggttcattgccttacctcaggtcctctgttcacacagaactggag

SEQ ID NO: 102074 - DNA, 409 bp, Homo sapiens
ttacccaggctggaatgtagtggtgcaatcatggctcactgcagcctcaacttcctagacttcagtgatctttccacctcagcctcccctagtagttggggccacaggcatgtgccacctcactgggctaatttttgtacttttggtagagatgaggtttcgccatgttgcccaggctggtctcgaactcttgggctcaagtgatctgcccacctcagcctaccaaagtgctgggattacaggtaatcacctgtatgattaccatgtccagcctgaaaggcaattaatttttgatactaactttcttagaacttctgagttattatcaattttaaaaatttgcctgcagatttcagattttctaaataggtgattgtatagtattccaataatgatagtttatttcttt

SEQ ID NO: 102075 - DNA, 370 bp, Homo sapiens
gcctcccataagggtctgaagtggcaggtggatgggaaactgcactctctgacctctgcaaggggactgctgctttcccatgagcttctcctctttccgttgctggtttcttctttgttatctttgctgctggagtggccagaccctgggaagcgggctggagagaggagagaagccatcgagccacatggacccctacagcccggaatctgagctgtggtaggattggctgcgattgggattggcagacacactgggtttgtacaggaggggaccctgaaggatgggctgtggtcaaagtgggatcccttcactgtccatagtccttggatctgaaactgctgacaggtgcccctgggaactgctgtgg

SEQ ID NO: 102076 - DNA, 407 bp, Homo sapiens
ttttggcatggtaagggcttgcatgtattaattcatctaatcctcacaccagctctatgagattgatgccattattaagaaaggtaaaacaagtattcaattatgataccccgcatttcaattacattgccatgacttacctcattatagcctcatataggttaccatagactagttctaaatttcaaaggcaaaaattgccaaagatttgaatccaaagtagcatgcagactacagtcctgattatattttaagtcttttgttaagtataaaagaagatagtgaagcaaattctggataatttgctgcattagtaacttaataatacaactttttcttgaacctgaaatcatgtgttgatcaaggagtcttaccaacagtgtcttacatctctttagagagtgcct

SEQ ID NO: 102077 - DNA, 258 bp, Homo sapiens
ccatatttcatacttttatatgttccacactatctactgtggtaggtacaccaagcacattataggtatttcaatcaatgttaaagcaaatactaaaaagagttatagttgcaaaggagacaggatgctccagtgaagtgtgtaagagacagaagattacatggaccttctgattactttgagaagaaagtctcagttcctaatacctctctaacattttgctaatatttaaacataaccaatttttaaggtaaacac

SEQ ID NO: 102078 - DNA, 135 bp, Homo sapiens
gctgtctctacatttttgattttgacatacatggtgtcagcagtgggaccaagcactgaaccactttggggagaatctcacactggggccctctgacacccttctacctttgtgagtcacctcttctcccacctg

SEQ ID NO: 102079 - DNA, 550 bp, Homo sapiens
gaggacatttgaaaaaggtggaggaggtggaggtgtggctgtcactagggaagataggagctgggcctgaggggaaaaaacagtgaagagaaaatgtaacaatgtgaaagtgagtgctagaaaagtctaatgagagaagagaataataaagaggagaaaagaagtgtttttaccacacagatgctacccattttactggtgagaaagctcgagccacagggaaataacatgctcaacatgaagctcctcttttttcaaacactatattttcctgtatgtcttattggctggaaaataaaataacagtaacagagaagcttggcttctttaagagagtatcggccaggctcgatggctcatgcctgtaatcccagcattttgggagaccaaagtgggaggatcatctgaggtcaggagtttgagaccagcctggccaacatggtgaaaacctgtctctactaaaaatacaaaaaaattagccaagcgtggtggtggatgcctgtaatctcagctactagggaggctgaggtgggagaatcacttgaacctg

SEQ ID NO: 102080 - DNA, 1281 bp, Homo sapiens
cttggcaaggctaataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagt

SEQ ID NO: 102081 - DNA, 1683 bp, Homo sapiens
ccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctgagcagagagtacggtggaggggcatgggcctgctgttggcggtgagggccttggaaatggcttcctggaggagatggcaattatccaggtagacaagatgtgtgtgtgtgtgtgtgtgtgtgtgtgtgtgtgtgtgtgtgtgatcatgaagaagaaataatgtgcaaagccctggtcataaataacttttcctctgcaaactgtggatggcagttcaccatgtttctcaccactggcctggtcactgcttatccaatatgcatgtaagaattactttttctcttttttcccttctataaattctcatagaacttcctttaatgcattaaaaaagcaactagcatgttcaa

SEQ ID NO: 102082 - DNA, 1227 bp, Homo sapiens
cttggcaaggctaataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagt

SEQ ID NO: 102083 - DNA, 1717 bp, Homo sapiens
ccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagt

SEQ ID NO: 102084 - DNA, 572 bp, Homo sapiens
aatcccctcatgtaaataacagtttttatgtaatcatcattcacgctgttgatgatggtgagtgtttacccaaaattggaaaaataaaatgctcattcttgcttcctgcgggaaaataaccctggtgagcgtctttcagcacagcagagaaaaggataaaataaaccttgttatcactctgcatccatgctggtgattatttttggtaataattcttaaaatggtaaacaagggaccaataccatcgaaagagggcagtattcattcagaagagacaattaaaccagcaaggaggctgcaatcaaacccagcatctttttcatctgttcatgagctaactctttagctctttgtcaaagccaatgatgtgtgataaatatttagcacagcttccctgtgcttgggatggcatacgagctcagataaatgggactgtaagggacacatttgtcataaaccagaatgggtggttttataagcctgtttcagcatttttctctacactctcctaaggctgaaactttaaacacaccaaagcagagttgaagaaataaaaatgttcaaataacttt

SEQ ID NO: 102085 - DNA, 753 bp, Homo sapiens
ccagttgattaagggctaccagaaatatgaggaaaccctgtgattttgctcctcaaaattcagtttgggggactatagtgatgatttcagcctgggggctgtgcaacctctctgcaaaatcatcatctttcatcctattggaggcctggaattttcaccttcaaagtgaactccccataatagtatgaaatttggagcccttgctgcctctagagagctgtaaaagtccccagaatctcctggaactctcagaaaattcccaagtggaagaataagattgtcttcctcagtaagctacatggctctgccagcatgggtctaccagcctctcactgcctcacaagggcttctccacgtgtccactccagttccccttgcttagcttccatcccaggatcacattcgggcctccctaccagattcctcccctggctgtgtacacccaggcctggccacggcttgaaaactatttttgcattccactcacaggagactgctgagccgttggttgcagactgcagtgtgcctttgtctctgtcaccctgacccactgcagggaaatgagcagagctgtggcggaacttctctagaacaccggggtagaggccccacttacaggggtctgcattccctggcaacctcaaacagatagcctccccatgacggcagaggctcagttggaaaatgaagaatttcttgctagccatgtctccccaccctattctagatgtggagtagccagttttctggtgc

SEQ ID NO: 102086 - DNA, 259 bp, Homo sapiens
acattgtgaggatgcattcctgggatgcttgctcttaatattggtgaacttgaagcttagaaaaagtcttcttgatttttatgtgttgtcaagtttgaccaattctaattatttggaagtaagaactcccaccactaactagtttgacaactgaaagtccaaacttctattctaaacaactgctaagtctctatgatgtgttcttagtgagtcacgtagccactgatactccactttcctactccattcattcactttc

SEQ ID NO: 102087 - DNA, 313 bp, Homo sapiens
aaaaaaaagaatcctactttgcacttgcagaatgtgagactttagcagttgaggtgtcttgctcacggactcgttgagggtaagtgcagggcaggcctggagccgatggattatatagcaaagcaggtcgatgtgaggtgaccagatttgtcccttggcaatttccttaagtgtccaccgcacatcataggcaacaagggctcagaggttcccaggggtggctttggagtcctgcagcctggctgcgagcacgagagccatgcaggtgaggtggcagatattcagctcttcaggacatttccccaaccatttg

SEQ ID NO: 102088 - DNA, 700 bp, Homo sapiens
catttgtgttgtttttgtgtattcaccatcatgagtcaggctgctatgaacactcgtatgtaagttttagtttgaacatatatttttatttctcttggatttacactcaggagtgaaattgttgcattatgtgattactatacatttagtctttgagaaactgccacgttgattttcaaagtggttacactggtcaggcgcagtggctcacacctttaatctcaggtatttgagatgctgagtttggaggattttcttagcccgggaattcaggacaagcctgggcaatatagggaaacaatatcttgattttttaaaaaaatcaaatgccaataaaacacccaaattgattacaccattttatattcccaccagtaatgtatgtgagttccaattattccacattgtcaccaactttttttttttttttgagacaaaatcttgctctgttgcccaggctgatgtgcagtggcatgaacatggccagtgcagctgtgaccttccaggcacaagtgaccctctcacctcagcctcctaagtagctgggacttacagttgcatgctatcatgtgcagctgatttttacagtttttggtagaaatgtggtgttgtcatgtagcccaggtttgtgtcaaactcctgagctcaagtgatctgcctgcttcaccttccggaagtgctgagattacaggtgtgtgcc

SEQ ID NO: 102089 - DNA, 452 bp, Homo sapiens
ggcacttgcaatgaatattagtgttcaataaacaatagattaatgaatgaatggttataaaaatgacaaagtactttttttacagcctttggatgaaaacatgattattaagacttgctgctggaaaaaaataaatcattcttttatttatcttcaaatccaagtagtttccaacatgtacacccaaatcaaaattatgagtattatttttaatagattcttttttcttcttgagtttaaacaatgagtcaaattttataggcaccccaaagctatccaaaaaaaatctgcccttgaaatgctgaagaccttcagtgtgaactaccagtcaaattgcaatcgtattttgaaatcttaatttccttcccaagataggactttaagcctttttctattttgatgatgaaatattggatttatagtatagaagggtaaacttgaattttcataat

SEQ ID NO: 102090 - DNA, 501 bp, Homo sapiens
caagggatgttcctctgcactcctgcatgtgccctggcctgatgccagttccaggcaggtccccatctggggagatctggatgctatatggacttcattaaggggaaggcagagacctcggccccagggagccagaaatggaaaggagacatggccttaacataaagtaagggttctgactccaacctgggagacgaatacagaacataaacatgtctttcctccaccacgctaagcagttcaagccagagtaggactgataataacagaaagacctacattctgtagggatattgttgcagtgaaagtgtttgtcttcaaatagggggaggccatgtgggcagaggcattgaactggttctctgaggtctctcgacacctcactaggacccacgaggagaaggcagaagcagaatgagttgggaacattttctcaacgttgattttatctgaaaatgtcacagtttcctatcactggaggtgtgcgggaatatactcgtt

SEQ ID NO: 102091 - DNA, 976 bp, Homo sapiens
ccggggcgcaggcgctgggcgcggcggggaagggactcggcactggggaaacccggagtttcagccagggtcccagggcttccttcccgggttcctgccggaaaacttttctcctccgcccggaagcctcgatggggcagtgagatcgcggggcgaggtgggagtgtgggagggggccgcgggcagagagcgggagtccggctgggtgggagatctcctgagccgaagctgggtctcgccccagcgtggcgccaccgacccgcaggcttttcctgctctgcagatggagagacacagggacgctcctcaggtggctgccctgggctgccagcctgtcagtgggaggggagggtgcagacaagaggcccctgtttccgaaacccctctgtccccaaagctgcgacagcagaagacacttaggcggcctgaggggttggtgaaccacagaggagctcagcttcgcctggtctccagctcccggtggcggtggcgtgtccttaatgctgctggctttgaactggactgagaactatttaccacacaaacaccaccatttcaatcccggagaatgcctgttttccctagggtgacctggccggggtaacaaacacttgttctctaattccacggtcagccttgacttaattgaggtacttgatttccaacttcctgtcttgctgccacagataatcactgatgaaaccaaacaggcaacaccttttggtggtcctgtggagagcgctgccccgtctgggtcttaggaaggcaattgaatatgaatgttctcccgagtgcttgtggaaaagagatggtgttggccactttttagacgaagagaaatgagtactagtgaacactaatcatagtgactaaacagtaaacggctcccatttgttgtcggctaaagcactgattcttcattttccatcccagcctgtcctgctctggcctgccctgtgctcaggaagctggcggt

SEQ ID NO: 102092 - DNA, 405 bp, Homo sapiens
tttttttttaaacagtaaatatttttagttataataaaggtaaggattgtataattttctctagaaaaagaatcaacatttaaaacatacatttgctcctatgctgtctaacagttcctttatttcaaacttagattttggcactctcaaatcataactactccaaaaaaacttatgggtgacattgtaaactagagctaaaaagaaaatctacagaaaattccctcaaagcactgaacaaattaagattatcttcatttcctttacccaggtatggacatctgacatactcttgctctttattacagtaggcaagtactcaatacagcctatgtaatgttctttttaaaaatgtccatttaataattatgaaacgctgctcactttgtaaccatttgtaatgca

SEQ ID NO: 102093 - DNA, 339 bp, Homo sapiens
tggggccaacggcagcaaggaggccttctggctcttggtatctcctttgattctccccaaagcctcaggagagtggctacaattcatctccccatttccagatgaggaactactgagatgcagggatccaagtcacacagcaggccaagatgacgctggagcccaggcctgcaggtcctgagccacagccattctttctgctccaccgacacacctgctacttcctgcacccgccatcgcctaggcacttccctctgcctgatgccctttctccgttcctgccaggcccagctgagggttccccagccccactcccctcatgcctgcagccccgccccc

SEQ ID NO: 102094 - DNA, 767 bp, Homo sapiens
acttttttcatagcaaaattcctgcaaggctgctactgctttatggaaaaggttcagaaccatacctggaaggttatccaaagactccaaagaggaaataatcaatctatttttataagtcttccaacccaactttgtctacttaagaaaaatcagtctcactccaaatgagatttattgaaatgttcctaaaatgcctcctatttacctatcacaagtgaaacattattcaaaatgtggaagtggtttgtggagatgggtcttttcaatttaagcctgcttgtacaatcttcactgggatcgtgtgactgcagaccctggtttcacgagcaactgtttgacatatcttctccagacagcatttcgcacttgcatatcagctgcagcctttccaaaagttggggaaatcctgcaaataaggaacatggcatctgattcttggaataacattctctctacactcttccagctgctgtggatacatgtaatgactgattttatttaataagaaagctcaaaatatttcccaattcagaacataaccctgcatgctgctccctctagtctaaccagaaatcccattctcctcctcctctaactcaataaaccaaatctaattggagaataattataaaatacactgatgtgcaatttgtttcacttgctcaataattaattaatacactacttatgattcagaagagctcttaagacacagcacaaattccactggatgaaggagaataccaaagatataagccaggggc

SEQ ID NO: 102095 - DNA, 552 bp, Homo sapiens
tctgcattttgtctttcaggcaagcagtaggggactcctgacgactttaagaaaaggagtgtcgtggacatttgagagagagagccctggcattgagttggaagatttactggaggaggagtgggcctaatggcagggaagagacccattggaggatgctggagggtctgggaggatggatcccgaatacctgtaccaaggcagggacagtggggatgggaagtcaaaaccaggttggagaggtatttaggaagagaatcaagaggacttgatgatcagctggatttgctgaatgctcgatgcctttttcccctgtgactccagccaactcagatttgtccttcaggaccaagctctctctgggaagcctcactacagtcctccgcttcatggacattgaagctgtcgtctcactgtgctttactagactgtttactggtgccctcccactgtgaggtccttgagagcaaggagtgtgtggattacacacttatttcctcatcccctagcctaccacttaggaaatgctcagtaaagtatgttggataaatg

SEQ ID NO: 102096 - DNA, 3891 bp, Homo sapiens
  misc_feature (199)..(199): n is a, c, g, or t
ccggctttcttccgtcctgccgtccccgggcccctagcccccagtcccctctcccccctccacctcttgtccctcggcctccgcgcctcccctcccccgactctctggcctcccattcattccgtccgctccctcccatttcctcttttccgctcgggccctctccccagagcctccccgcgcggaccccgctgcagtntcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaatgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaatt

SEQ ID NO: 102097 - DNA, 2196 bp, Homo sapiens
agagagtgactgcaaggagagatttctaaaaatatattttacaaatactcgaatggtgcttaccatgtaccagcctctcccatgctctttacaggcattaattcatttaatttaatcctcacaacaatggctgcaccgactaggcttgttttctggtacaacagataaaagtctactcctggggagagctaatcagtcttaacaagtaccgtgggggacacttgccgaacaagagaaatcaagagatagggttaaaattaggggagaaaccgatggcagtcatctatgccagctaggttcatctgtacagtcttcagatttcttatagatgaatcatcaaattctataatgttactacttctctctcagtttatagtaaactttcctttgaaaaagccaaccttgcctgagaagaatggtctaccactaggtcagcaaaggtatggaactctcttttgactagtggtatggtggtattagctttgtaaacaaccagtctaactgatgcaaataaagataaatgaacagtgggattggagaggggaaaatcacaatttttgcttcctcagcattcatgacttctttggcttgcatagattttgtttttctttattttacaaatgagtttccttttaatgttgttccactttgcatttcaaatttcccttaagcatctaaaaatgttacaaaatagtgtcattacctttcaaattaaacatcaaattagccagagaagttgagttgtgagtactccaacaagcaaaatattaaaaaatgaatttcaacttggtgatcccacctagtgaactaatgggatataaggaacctcttacgtcccagacaccatgcttagcattatgcacagttatccatttaatctcacagccttgcaagggggtattatatccactgtttgagggcggagaaaacaggctcacacaaagtagtagcttccaggggtctcacagttaatattaatgaaaggcttgggcttatacataggtgtttcaggttccacattgcaaagcattatctcagggacgatctatggcatgcgcatcccgataaaaacgtaccaaatttattggctatcaactacagttccatctggaaatactcagcaaataatggcagtaaggcatcccgccacttcctgcatgattagttgaaaaagaaacacctgcgcacacacatttgaacaatgtgatacagctaaggacctggacagtcagctagcaggaagaaacatttgaacgaagggtagaccacggcctaggaggtggatgaagacacccgtccgtttgcctactgaagcaagatggggctgaggcgctcaagggcctattggctgcccagaagcctttgcagcgccgcctgaatacagcgaggatgacccagggttcaccttcagcgttgaaggcaagtcctggtataagggacgcacataggtccgcgccacatcctgacactgtttccacaggaagtgcgggataggaggggggattcattaatccaggtcggaaatacaccttgttcctcgaggattttggaaggaaattccacccgcgaagtccccttttggagatgcccttttcctttcaggtacagcatccttcattatgtacccccagggtacaatgtatccggggctcgcaacgcgtccctcaacccccagcagcgcggtcaccgcggggtccccgggcgggcgggggcggcggtgacgcaggaggcggtggggccccggtgcggcgggcgcggggagggggctgctgggcgcgggcctatcaggacgcgcggtgtttcgggcgcggggagggcggggacctccaggtttcctcggggcccggcgcagcgccgcctgccgagttccgagcgagcgcgcgaagcgcgcaggggtctcgagacgttcccgccggtcccggttttcctccgcggctcccccgccccttcacgtccgcctctttctccaaccagacgcggctccgacggcgctcggcctctgctcttccggctccccggctctgcccgcagcgcgcgtcgcccggttgctcttcgcctggtgtccgcgggcccggcgggggcgcctcaccccgggcgcgcggcggtaatgccgctgccgcccttgcggccaggcaggcagctggcggcggccggagtcggagcgcgttcgtcgctggccgggacgccgccctggcc

SEQ ID NO: 102098 - DNA, 3869 bp, Homo sapiens
  misc_feature (177)..(177): n is a, c, g, or t
actcactatagggctcgagcggccgcccgggcaggttccacctcttgtccctcggcctccgcgcctcccctcccccgactctctggcctcccattcattccgtccgctccctcccatttcctcttttccgctcgggccctctccccagagcctccccgcgcggaccccgctgcagtntcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaatgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaatt

SEQ ID NO: 102099 - DNA, 5162 bp, Homo sapiens
  misc_feature (177)..(177): n is a, c, g, or t
actcactatagggctcgagcggccgcccgggcaggttccacctcttgtccctcggcctccgcgcctcccctcccccgactctctggcctcccattcattccgtccgctccctcccatttcctcttttccgctcgggccctctccccagagcctccccgcgcggaccccgctgcagtntcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaatgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaattataggatgttggaggatttattaatgagcatgtattgattgcctattccatatccagtgcaatgctaggtatgtctatggaaggagtattattacttcatttctaaacaaatgaagtcaagcaaattgagatctttctgaaattatgaagacatcttctgataacttatctgttgtatttcctagtctcaaagtcaagaaacccgtatatgtggacctagggctaataggaggtccctatggcactaactgggaaaattacatggtgcttttcaactacagaaagaagtaatgactaatgggcctgtctgtagagaagaaaaggagaagagtacacatttgctggaactatatataattcacagtggagatagttaattctttgctaaaactagggttttatgagtattttttaaatctacatttaagtttttgtttttgtgaaaagttattcagtaagaaaactttataatattaagtagatacagttatgtattaaaaatttccttatatacccttttgccagccaagatactgatattttaaaacaaaatggaaaaatgtccaatacaatattctctttctggaggcttcctacaagtgaaagcagattttgtcattttatttggcctttgcttgtctttgatatatttctttatgtgtttttcaaatacatactgttgtagatttattgtcttgtatttgcaagtatgccggttgagagaactaaaatggttatagtattgtttatcagaaagaggaagtgtacttaagattattttatttatttagatgaaaggcttctacataaatgcactgaaataaatgctagtaatttcttgtatcccacttctttttttgcttctcatggaaatgtttgtacttttttatcattgtcttttatgaaatataatgttctaaagaaaaaaaaaaaaaaaaaaaaaaaaaaaaaacaaaaaaaaacaaaaaaaaaaaaaaaaaaaaaaaaacaaaaaaaaaacagaacagcacaaaaacaaagcacaacaaaaaaaaaacacacagggggcgacacgacgcagcaaggacacgacgagaaaaaagagcagagggcacgcagcccacaagagagaaacgaagaaggaaaaacagacgagaacagagaaaagagcacgagcaaaaaaaatgggatgagaacacacacgaagaaaaacaaccgggggcgacaaacgagcgagtgaacaaacaacaggagggaaagggagacaagagaggcaccaaaagaaggagagagaagaggaccaaaaaaacgccg

SEQ ID NO: 102100 - DNA, 6374 bp, Homo sapiens
agagagtgactgcaaggagagatttctaaaaatatattttacaaatactcgaatggtgcttaccatgtaccagcctctcccatgctctttacaggcattaattcatttaatttaatcctcacaacaatggctgcaccgactaggcttgttttctggtacaacagataaaagtctactcctggggagagctaatcagtcttaacaagtaccgtgggggacacttgccgaacaagagaaatcaagagatagggttaaaattaggggagaaaccgatggcagtcatctatgccagctaggttcatctgtacagtcttcagatttcttatagatgaatcatcaaattctataatgttactacttctctctcagtttatagtaaactttcctttgaaaaagccaaccttgcctgagaagaatggtctaccactaggtcagcaaaggtatggaactctcttttgactagtggtatggtggtattagctttgtaaacaaccagtctaactgatgcaaataaagataaatgaacagtgggattggagaggggaaaatcacaatttttgcttcctcagcattcatgacttctttggcttgcatagattttgtttttctttattttacaaatgagtttccttttaatgttgttccactttgcatttcaaatttcccttaagcatctaaaaatgttacaaaatagtgtcattacctttcaaattaaacatcaaattagccagagaagttgagttgtgagtactccaacaagcaaaatattaaaaaatgaatttcaacttggtgatcccacctagtgaactaatgggatataaggaacctcttacgtcccagacaccatgcttagcattatgcacagttatccatttaatctcacagccttgcaagggggtattatatccactgtttgagggcggagaaaacaggctcacacaaagtagtagcttccaggggtctcacagttaatattaatgaaaggcttgggcttatacataggtgtttcaggttccacattgcaaagcattatctcagggacgatctatggcatgcgcatcccgataaaaacgtaccaaatttattggctatcaactacagttccatctggaaatactcagcaaataatggcagtaaggcatcccgccacttcctgcatgattagttgaaaaagaaacacctgcgcacacacatttgaacaatgtgatacagctaaggacctggacagtcagctagcaggaagaaacatttgaacgaagggtagaccacggcctaggaggtggatgaagacacccgtccgtttgcctactgaagcaagatggggctgaggcgctcaagggcctattggctgcccagaagcctttgcagcgccgcctgaatacagcgaggatgacccagggttcaccttcagcgttgaaggcaagtcctggtataagggacgcacataggtccgcgccacatcctgacactgtttccacaggaagtgcgggataggaggggggattcattaatccaggtcggaaatacaccttgttcctcgaggattttggaaggaaattccacccgcgaagtccccttttggagatgcccttttcctttcagccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaatgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaattataggatgttggaggatttattaatgagcatgtattgattgcctattccatatccagtgcaatgctaggtatgtctatggaaggagtattattacttcatttctaaacaaatgaagtcaagcaaattgagatctttctgaaattatgaagacatcttctgataacttatctgttgtatttcctagtctcaaagtcaagaaacccgtatatgtggacctagggctaataggaggtccctatggcactaactgggaaaattacatggtgcttttcaactacagaaagaagtaatgactaatgggcctgtctgtagagaagaaaaggagaagagtacacatttgctggaactatatataattcacagtggagatagttaattctttgctaaaactagggttttatgagtattttttaaatctacatttaagtttttgtttttgtgaaaagttattcagtaagaaaactttataatattaagtagatacagttatgtattaaaaatttccttatatacccttttgccagccaagatactgatattttaaaacaaaatggaaaaatgtccaatacaatattctctttctggaggcttcctacaagtgaaagcagattttgtcattttatttggcctttgcttgtctttgatatatttctttatgtgtttttcaaatacatactgttgtagatttattgtcttgtatttgcaagtatgccggttgagagaactaaaatggttatagtattgtttatcagaaagaggaagtgtacttaagattattttatttatttagatgaaaggcttctacataaatgcactgaaataaatgctagtaatttcttgtatcccacttctttttttgcttctcatggaaatgtttgtacttttttatcattgtcttttatgaaatataatgttctaaagaaaaaaaaaaaaaaaaaaaaaaaaaaaaaacaaaaaaaaacaaaaaaaaaaaaaaaaaaaaaaaaacaaaaaaaaaacagaacagcacaaaaacaaagcacaacaaaaaaaaaacacacagggggcgacacgacgcagcaaggacacgacgagaaaaaagagcagagggcacgcagcccacaagagagaaacgaagaaggaaaaacagacgagaacagagaaaagagcacgagcaaaaaaaatgggatgagaacacacacgaagaaaaacaaccgggggcgacaaacgagcgagtgaacaaacaacaggagggaaagggagacaagagaggcaccaaaagaaggagagagaagaggaccaaaaaaacgccg

SEQ ID NO: 102101 - DNA, 2152 bp, Homo sapiens
agagagtgactgcaaggagagatttctaaaaatatattttacaaatactcgaatggtgcttaccatgtaccagcctctcccatgctctttacaggcattaattcatttaatttaatcctcacaacaatggctgcaccgactaggcttgttttctggtacaacagataaaagtctactcctggggagagctaatcagtcttaacaagtaccgtgggggacacttgccgaacaagagaaatcaagagatagggttaaaattaggggagaaaccgatggcagtcatctatgccagctaggttcatctgtacagtcttcagatttcttatagatgaatcatcaaattctataatgttactacttctctctcagtttatagtaaactttcctttgaaaaagccaaccttgcctgagaagaatggtctaccactaggtcagcaaaggtatggaactctcttttgactagtggtatggtggtattagctttgtaaacaaccagtctaactgatgcaaataaagataaatgaacagtgggattggagaggggaaaatcacaatttttgcttcctcagcattcatgacttctttggcttgcatagattttgtttttctttattttacaaatgagtttccttttaatgttgttccactttgcatttcaaatttcccttaagcatctaaaaatgttacaaaatagtgtcattacctttcaaattaaacatcaaattagccagagaagttgagttgtgagtactccaacaagcaaaatattaaaaaatgaatttcaacttggtgatcccacctagtgaactaatgggatataaggaacctcttacgtcccagacaccatgcttagcattatgcacagttatccatttaatctcacagccttgcaagggggtattatatccactgtttgagggcggagaaaacaggctcacacaaagtagtagcttccaggggtctcacagttaatattaatgaaaggcttgggcttatacataggtgtttcaggttccacattgcaaagcattatctcagggacgatctatggcatgcgcatcccgataaaaacgtaccaaatttattggctatcaactacagttccatctggaaatactcagcaaataatggcagtaaggcatcccgccacttcctgcatgattagttgaaaaagaaacacctgcgcacacacatttgaacaatgtgatacagctaaggacctggacagtcagctagcaggaagaaacatttgaacgaagggtagaccacggcctaggaggtggatgaagacacccgtccgtttgcctactgaagcaagatggggctgaggcgctcaagggcctattggctgcccagaagcctttgcagcgccgcctgaatacagcgaggatgacccagggttcaccttcagcgttgaaggcaagtcctggtataagggacgcacataggtccgcgccacatcctgacactgtttccacaggaagtgcgggataggaggggggattcattaatccaggtcggaaatacaccttgttcctcgaggattttggaaggaaattccacccgcgaagtccccttttggagatgcccttttcctttcagccaacacatatctctttatggtacaagctcgaggtataatgttgagagaaaatgtgaaaacaataggtcatatgatcaggctgtacacaaataaaaacagtacgctcaacggtacaggtaagactacttcctgcttaaccccttgtagttacaaagcagtaaaccaaatcttttacagtctgttttgccttcaggtaacttcctgttaaagatgaagaaggtatcttcccctaagcgtcctggtagattattttactgtgcaaatcaagactgttacctattttaggatgtatgaacgtgtggtcacaaaagtgatgaggttttgtacagacacttaagttaattcttgtaaacaaaatatagaaagcagcttctactttttcaattcgtatgttgtatttaagagaaattaaccagagaataatttattcatcttagtaagccatactaccatctctctttatgttcattctagttcctaagttgttcttccaactaggtctagaaaatagttgtttttaattatagaagattgttaatagtgttatgg

SEQ ID NO: 102102 - DNA, 599 bp, Homo sapiens
acttccccaattctgaatattattttattaaataaaaaaaagcttactgtgttatgacattctttctctatttttcttttatagccaacacatatctctttatggtacaagctcgaggtataatgttgagagaaaatgtgaaaacaataggtcatatgatcaggctgtacacaaataaaaacagtacgctcaacggtacaggtaagactacttcctgcttaaccccttgtagttacaaagcagtaaaccaaatcttttacagtctgttttgccttcaggtaacttcctgttaaagatgaagaaggtatcttcccctaagcgtcctggtagattattttactgtgcaaatcaagactgttacctattttaggatgtatgaacgtgtggtcacaaaagtgatgaggttttgtacagacacttaagttaattcttgtaaacaaaatatagaaagcagcttctactttttcaattcgtatgttgtatttaagagaaattaaccagagaataatttattcatcttagtaagccatactaccatctctctttatgttcattctagttcctaagttgttcttccaactaggtctagaaaatagttg

SEQ ID NO: 102103 - DNA, 3370 bp, Homo sapiens
ttgtatccgattggctggtctgggcgcgtcactgctggctgaaggctgcgctcaggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtaattgtgtgttgtaaattttttaagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaataagttgcatttattctctttcccagggttactcctttgaagagggcaaaattcagttgggaatataaattctggaatcttcatgaagaaaattagttaacagtatagacatgccctacaaatatcatccacaggcacttcattcaagaacttcaggtgtcagagtgcctggagctctggagcttagacattagagttgattccttggggattggttccaggacacctacttggataccaaagtccacagatgcccaagccccttttataaaatgatgtagtatttgcatattatgtatgcacatcctcccatatactttaaatcatctttagattacttatactgaatagaatgtaaatagtatttacaattgtgaatacaatgtatttagttatgtaaatatgtaaattttaaagttatgtaaatatgtagctatgtaaatagctataaaataatatttacaattgtgaatagtatgtaaatagttgtgaacataactattgtgaatactatgttatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgagaaggaaaaaaagtatacatattcagtacagatgcagtcatctttttttcccctcgaacatttttgatccacaattggttgaatccacagatggggaacacacagtcttggtaaatttaaccaacaaggagggtaaacgcatcccaacagggaaggtaaactgcacatccatcagtacctctagagggcatcactggtttatagctcaatacagtgactatatcagaataatggcctttagttttcctgaaagattaaattaggcttgctgttgttgaatgagataatcaaacatatgatgtaattttaaagggtttacatacagaaggcctgctgtatgtcctgcttctgctgtgtaaaagattcagcatggaatcattggaattttatgtacaggatttcattatctcattttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaatttaatggggtatcagttaactaattttacttagatggaacttctgtaagcttagtaggtatgcttaaataaagcctgctaataaaatagagattcagactcaatagaatggttttacatatgtaatatatgttttaaacagcataaaataaactcctccctccttt

SEQ ID NO: 102104 - DNA, 1462 bp, Homo sapiens
  misc_feature (1105)..(1105): n is a, c, g, or t
  misc_feature (1113)..(1113): n is a, c, g, or t
ttgtatccgattggctggtctgggcgcgtcactgctggctgaaggctgcgctcaggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtaaaaaaaaaaaaaaaaaaaaaaaaaaaaaaaaaaaaaaaaaaaaaaaaaaaanaaaaaaanaaaaaaaaaagaggggggggggggaaaaatactacccaggggagggaggcgacaagtttacgatgccagcaaacgatgttgttctaatatagaggagggctccccatgatgagagagtgattttattaaaacgacgaaggagcgcgcctattctaaaaccagtcgagtgatggaaaaaccactcattcatgttatgatcctatgaaagaaggcaccaatctttgggggcggggagaaatagtgggaacaacccatccagcaatattaaggctgcgtgagatatataacatgatagttattggtgacacactgctaattcttcggaagattagctggtatttataattag

SEQ ID NO: 102105 - DNA, 3336 bp, Homo sapiens
  misc_feature (20)..(21): n is a, c, g, or t
gatctagagtatccccgtcnnatcttctgaatccatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtaattgtgtgttgtaaattttttaagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaataagttgcatttattctctttcccagggttactcctttgaagagggcaaaattcagttgggaatataaattctggaatcttcatgaagaaaattagttaacagtatagacatgccctacaaatatcatccacaggcacttcattcaagaacttcaggtgtcagagtgcctggagctctggagcttagacattagagttgattccttggggattggttccaggacacctacttggataccaaagtccacagatgcccaagccccttttataaaatgatgtagtatttgcatattatgtatgcacatcctcccatatactttaaatcatctttagattacttatactgaatagaatgtaaatagtatttacaattgtgaatacaatgtatttagttatgtaaatatgtaaattttaaagttatgtaaatatgtagctatgtaaatagctataaaataatatttacaattgtgaatagtatgtaaatagttgtgaacataactattgtgaatactatgttatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgagaaggaaaaaaagtatacatattcagtacagatgcagtcatctttttttcccctcgaacatttttgatccacaattggttgaatccacagatggggaacacacagtcttggtaaatttaaccaacaaggagggtaaacgcatcccaacagggaaggtaaactgcacatccatcagtacctctagagggcatcactggtttatagctcaatacagtgactatatcagaataatggcctttagttttcctgaaagattaaattaggcttgctgttgttgaatgagataatcaaacatatgatgtaattttaaagggtttacatacagaaggcctgctgtatgtcctgcttctgctgtgtaaaagattcagcatggaatcattggaattttatgtacaggatttcattatctcattttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaatttaatggggtatcagttaactaattttacttagatggaacttctgtaagcttagtaggtatgcttaaataaagcctgctaataaaatagagattcagactcaatagaatggttttacatatgtaatatatgttttaaacagcataaaataaactcctccctccttt

SEQ ID NO: 102106 - DNA, 3282 bp, Homo sapiens
  misc_feature (20)..(21): n is a, c, g, or t
gatctagagtatccccgtcnnatcttctgaatccatcgaagatggcggcgcgatctgtgtcgggcattaccagaagagtcttcatgtggacagtctcagggacaccatgtagagaattttggtctcgattcagaaaagagaaagagccagtggttgttgagacagtagaagagactgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtaattgtgtgttgtaaattttttaagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaataagttgcatttattctctttcccagggttactcctttgaagagggcaaaattcagttgggaatataaattctggaatcttcatgaagaaaattagttaacagtatagacatgccctacaaatatcatccacaggcacttcattcaagaacttcaggtgtcagagtgcctggagctctggagcttagacattagagttgattccttggggattggttccaggacacctacttggataccaaagtccacagatgcccaagccccttttataaaatgatgtagtatttgcatattatgtatgcacatcctcccatatactttaaatcatctttagattacttatactgaatagaatgtaaatagtatttacaattgtgaatacaatgtatttagttatgtaaatatgtaaattttaaagttatgtaaatatgtagctatgtaaatagctataaaataatatttacaattgtgaatagtatgtaaatagttgtgaacataactattgtgaatactatgttatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgagaaggaaaaaaagtatacatattcagtacagatgcagtcatctttttttcccctcgaacatttttgatccacaattggttgaatccacagatggggaacacacagtcttggtaaatttaaccaacaaggagggtaaacgcatcccaacagggaaggtaaactgcacatccatcagtacctctagagggcatcactggtttatagctcaatacagtgactatatcagaataatggcctttagttttcctgaaagattaaattaggcttgctgttgttgaatgagataatcaaacatatgatgtaattttaaagggtttacatacagaaggcctgctgtatgtcctgcttctgctgtgtaaaagattcagcatggaatcattggaattttatgtacaggatttcattatctcattttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaatttaatggggtatcagttaactaattttacttagatggaacttctgtaagcttagtaggtatgcttaaataaagcctgctaataaaatagagattcagactcaatagaatggttttacatatgtaatatatgttttaaacagcataaaataaactcctccctccttt

SEQ ID NO: 102107 - DNA, 848 bp, Homo sapiens
ttgtatccgattggctggtctgggcgcgtcactgctggctgaaggctgcgctcaggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaaccatgaatatgtttcctgagcaggggctgcatagatttgtacttaccaggaattacgaagttctaaccatttcgtgggagtatacttgttccattacaggacaataggctcatcaatgcgaacatttaagactgcatttgacagtggcgcgcctgtagacggatgagtacttaggtagatgaagttccgggacactgagaggggcccattggctaaaaggggtcgaatcaagtgggaaaaggccatatgggattgttgtgtctttccttccttccgcag

SEQ ID NO: 102108 - DNA, 744 bp, Homo sapiens
  misc_feature (20)..(21): n is a, c, g, or t
  misc_feature (155)..(155): n is a, c, g, or t
  misc_feature (347)..(347): n is a, c, g, or t
  misc_feature (510)..(510): n is a, c, g, or t
  misc_feature (662)..(662): n is a, c, g, or t
gatctagagtatccccgtcnnatcttctgaatccatcgaagatggcggcgcgatctgtgtcgggcattaccagaagagtcttcatgtggacagtctcagggacaccatgtagagaattttggtctcgattcagaaaagggggagaaagagccaanggttggggttccttggggggggggagcttttttttgctggggggggggaaaaaaacggggggggaaaccaaaagggtttacggacaggacgaaaaacaagggaaaaacctatcctagttggtgtccacctttacgaaggccgaggcattacacaaccacctgaaagattctcccaagaaggtttcccggggntttttttttacttacccatcggggggggggggcgggggggggcaaaaaacacaaaaaacccaggttttttttcccccggttttttttttttaaaacccggttttcttaaacaaggaaaaagttttattctggggttttttcccatctttcttcctagtaattnggcaagacatcgtccctgtgaagatagtcgtctaaagttcaatccttctggctccatttctacacgcttggaattgcacctttttggcggggtccatggtaagtcccctaatcttcgcagacgtccaccaagatgtggcccaaggggggggnttttttcaaaacgggggggacaaaaggggcggggaaaaacattttgggggtttttctcccttttttcgggaactatttctat

SEQ ID NO: 102109 - DNA, 1053 bp, Homo sapiens
ttgtatccgattggctggtctgggcgcgtcactgctggctgaaggctgcgctcaggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgta

SEQ ID NO: 102110 - DNA, 4035 bp, Homo sapiens
ttgtatccgattggctggtctgggcgcgtcactgctggctgaaggctgcgctcaggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtaattgtgtgttgtaaattttttaagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaataagttgcatttattctctttcccagggttactcctttgaagagggcaaaattcagttgggaatataaattctggaatcttcatgaagaaaattagttaacagtatagacatgccctacaaatatcatccacaggcacttcattcaagaacttcaggtgtcagagtgcctggagctctggagcttagacattagagttgattccttggggattggttccaggacacctacttggataccaaagtccacagatgcccaagccccttttataaaatgatgtagtatttgcatattatgtatgcacatcctcccatatactttaaatcatctttagattacttatactgaatagaatgtaaatagtatttacaattgtgaatacaatgtatttagttatgtaaatatgtaaattttaaagttatgtaaatatgtagctatgtaaatagctataaaataatatttacaattgtgaatagtatgtaaatagttgtgaacataactattgtgaatactatgttatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgagaaggaaaaaaagtatacatattcagtacagatgcagtcatctttttttcccctcgaacatttttgatccacaattggttgaatccacagatggggaacacacagtcttggtaaatttaaccaacaaggagggtaaacgcatcccaacagggaaggtaaactgcacatccatcagtacctctagagggcatcactggtttatagctcaatacagtgactatatcagaataatggcctttagttttcctgaaagattaaattaggcttgctgttgttgaatgagataatcaaacatatgatgtaattttaaagggtttacatacagaaggcctgctgtatgtcctgcttctgctgtgtaaaagattcagcatggaatcattggaattttatgtacaggatttcattatctcattttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaatttaatgattgctacataaaaagggtatcagttaactaattttacttagatggaacttctgtaagcttagtaggtatgcttaaataaagcctgctaataaaatagagattcagactcaatagaatggttttacatatgtaatatatgttttaaacagcataaaataaactcctccctcctttcttaacgtgtcatttttctgattacaaaagtagcacgttctttttagaaaattgggaaggaaaaaagcaaaaacaagaatgaaaaaacaaaactatcttgccgctcataattacttaacattttggtatatttccaaatgaaaacaattattttcctgtattttacaattactatggcatcatgctccccttcacattataagcatttccccatgtttttaaagacaagaataacaaatttgattaatagcatattattgtataattagatgtcatgcaattatttaaccaatattcaactggatatttaaattcttcccagtgttttgcttttctgttctttttaatcctgcttttctagttcttagagaattggtctgccatagatctttctactcagaagtagaagatactgtactgtaaatttcttgaccctaaacctaagaatgaacaatttggtcctacttctttgattcataatcccattagcatgtattctgtgaatcctaaaacacaaagtgacaaggactttgaaattttcactaggttgttacacagtgcaaaaatcctaaagcttttacttgaaaagtttccaaatttaaaaatagtctgtaacctctgatcctatgaattccaaagttaatctcagc

SEQ ID NO: 102111 - DNA, 1641 bp, Homo sapiens
  misc_feature (1105)..(1105): n is a, c, g, or t
  misc_feature (1113)..(1113): n is a, c, g, or t
ttgtatccgattggctggtctgggcgcgtcactgctggctgaaggctgcgctcaggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtaaaaaaaaaaaaaaaaaaaaaaaaaaaaaaaaaaaaaaaaaaaaaaaaaaaanaaaaaaanaaaaaaaaaaaaaaaaaaaaaaaaaaggggggggggaggcgcacaacaaaaaaatccccactgaggaggcggcgccgacagcacagcacgcacccgcacgagtagtcttgattgagatagaagaggaggagcgccaaaaaaaaggaagtggagaacgataatataataaaagagaagaagaagaggaggacgaagaaaagaaaacaagacactacagaaggagggaggaaaaacaacagccgacaagaacaggaacaaacaatggaaggagaaaaaggcacaccaacaatagctgagatgggataggcagaaacagaacaacaagtaggaggaacaacaccaaccgcaccgcgacgaaagaaaattaaaagcccacaccagggagaacaacaccagcaaaactcagccagcaagaatcaaacgacgggtacaaccaaaaacaccgacgaaagatataagaggcggaacagaaaaaaaaatatgagccataaaaaagagtaataatgcacaaaaacacaattgatacac

SEQ ID NO: 102112 - DNA, 3329 bp, Homo sapiens
ttgtatccgattggctggtctgggcgcgtcactgctggctgaaggctgcgctcaggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaattacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgtaattgtgtgttgtaaattttttaagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaataagttgcatttattctctttcccagggttactcctttgaagagggcaaaattcagttgggaatataaattctggaatcttcatgaagaaaattagttaacagtatagacatgccctacaaatatcatccacaggcacttcattcaagaacttcaggtgtcagagtgcctggagctctggagcttagacattagagttgattccttggggattggttccaggacacctacttggataccaaagtccacagatgcccaagccccttttataaaatgatgtagtatttgcatattatgtatgcacatcctcccatatactttaaatcatctttagattacttatactgaatagaatgtaaatagtatttacaattgtgaatacaatgtatttagttatgtaaatatgtaaattttaaagttatgtaaatatgtagctatgtaaatagctataaaataatatttacaattgtgaatagtatgtaaatagttgtgaacataactattgtgaatactatgttatatgttatagttgtgaatgtaaatagtattcacaattgtgaatacaatgtaaatagctttcacaattgtgaatacaatgtaagtagctatgtaaatagtgaatacaatgtaaatagctatgtaaatagttgttatgctgattagggaataatgagaaggaaaaaaagtatacatattcagtacagatgcagtcatctttttttcccctcgaacatttttgatccacaattggttgaatccacagatggggaacacacagtcttggtaaatttaaccaacaaggagggtaaacgcatcccaacagggaaggtaaactgcacatccatcagtacctctagagggcatcactggtttatagctcaatacagtgactatatcagaataatggcctttagttttcctgaaagattaaattaggcttgctgttgttgaatgagataatcaaacatatgatgtaattttaaagggtttacatacagaaggcctgctgtatgtcctgcttctgctgtgtaaaagattcagcatggaatcattggaattttatgtacaggatttcattatctcattttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaatttaatggggtatcagttaactaattttacttagatggaacttctgtaagcttagtaggtatgcttaaataaagcctgctaataaaatagagattcagactcaatagaatggttttacatatgtaatatatgttttaaacagcataaaataaactcctccctccttt

SEQ ID NO: 102113 - DNA, 480 bp, Homo sapiens
ggagatggaggttgcagtgagctgacatcatgctattgcactctagcctgggcaacagagtgagaccctgtctcaaaaaaaaaaaaaatacttgggggaaacaataaaaataaccatagaaaatataagttaatataattatatagtattcacacttttaagtattataaataatatagagatgatttatacgggaagatgtgcataggttatatgcaaatactacaccattttatatcaggtacttgagcatcctgggatttgagtatctatgggggtcctagaaccaatctccctcaggtaccgagggactatactataccttgttcttgaacgagatgatttgacattttaaatagatgttcccctagattaatctgtaaatataatacatttccaaccagaatgctaacacattaatttttttttttaacgatctggaaaaaataaaaatacataggaaaatctgaaaaaaaaaaa

SEQ ID NO: 102114 - DNA, 783 bp, Homo sapiens
gaagccatggggccagttgccatgatgcagggagagtgtggaaagtgagagtccagggtgttggctgaggaagaggagcctgagaggaaatgaggaagtaagcagtgggaggaaccaggagggaaccttcacaggagccagggggaccaaggggagagttcaacaagccaggtggccaaggggctccatatgaggatgtgaacatgcagtgtggccataagaggtcattggtagtgcccatggtctaataacaactctgcattttacagactgagatacagactgggatactgaggcccagcgagcggaaatgggttgcccaaggtccacagggacttaggagccgagctgactcctggtctcctgactcccagttgaaggctgacccccaagtgatggcttctgaacgatggggttaagtgaccagcatgtagccacaggcagggaactgatgggagaagacctggtctctgcccctgaaattgggttgtgaggtacatgcagcaagcaaaattgaggttagacacagaggttgtactgaaggtctggaatgggtgacttcaaagcaagggcaagaggaattctctctttgaagacagctcagcacattttgtagactcaagtagtagctgcagggggatggccagaatgacctatgccccttatgcagttactgcgttgacttcccagacgagctgagagctgacattgctatgcacctgaatcgggagatcctgccactgccgtagtcgggggcagcgagcaggggctgcctgcgggcca

SEQ ID NO: 102115 - DNA, 400 bp, Homo sapiens
ttgctgaatggcttgggctctgggagggcatagcagcatccacctgcgcagggctgacagtggtttcctttgtctggaatgacgtgcttaatgttaataaggtctggaatgttgggagtcaagacagattttcttttggaatctctttggtcttggctccctgtaacagataatgcttgtgcttttctgttttctgattaaagtaggatatttagtagggcttttgcacttcacaagtggcagatttcctctttctcttgtaagctttttctgtcttgtgagcacatatcctaggcatgctcagacgagcgtgttttggaaggctggagttggcagggttcttcttttcccccagagtatctgcttcccttactgcatttgaacactgtactgtttctag

SEQ ID NO: 102116 - DNA, 446 bp, Homo sapiens
catgctgttgctgttggcttgcctcccttatacatgaaaaactcctatctgttccttgaaatcaagctcagatgctggctcctctgggaagccttcacttgtatcaacccccctcttaccctttttccccaatagaaaaaacctatttttcagttctttatatatacatttctattactatatttatctgagtaacagttcaaggatctgcctgaattataaagcatcatatccaaaacctgaaaaaaaatgaataatctttaaaacataagataatcagattccaaggaagcaaagaggaaaaagaaaaaagcaaagactacttaggaaatggaaagaggctatggaatacataaagttgtcttaaaggtagtacactatataataatacttttgcttctctttaccatttggtttgctctgtcaattaattttatttataacca

SEQ ID NO: 102117 - DNA, 466 bp, Homo sapiens
gtttctctgatcgctctgtcacaaccattctggtgaagaaagaatactttcctcaggtgatcctcttgcctcggcctcccaaagtgctgggattacaggtgtgagccaccacacctggccgattactctttttctaagaatctttccacctcactgttacactttttcttgtgtgagggtttcattctgtcttctcaccaaagatagaactttcttctttgggaacagggcagctagagctgtgggtgcgtccagacagattctttttgaacctgttaataaacatgtagatctaggtttttcatcacacccctcattcctccaggaaacctccttatgatactctcagcttggtcttgcaccctttccatcatttgccacttgcagtgatcacagttagtgtctgcctttcctgtgtccgtatctggtggtcacagttactgtctgcctttcctgtgtccatcca

SEQ ID NO: 102118 - DNA, 288 bp, Homo sapiens
gaatgacaactgacactttagaccttgggttggggagaaaatgggaaataataacagccttggggaagtctaggagtccttatgccctgcttaaggtgaaactgatacagaattctggctgatggttgctatttgagatgctgtttctagatttttcaagagggcggaaatttggatttttatgatttttttttttcttttttgagatggagttttactcttgttgcccaggctagagtgcaatggtgtgatctcggctcactgcaacctctgcctcccgggtacaag

SEQ ID NO: 102119 - DNA, 674 bp, Homo sapiens
ctcttttgtcaattgcacttgaccttttcaggaaaaagaaatcaattgataccttagtcctaatgtttgacccttttctatctcagaatagagaagtccctgtatttgttctttttttactcaagtttaatatagaccacctaggcacagaagctccgtgctatattctgttgcctgtaattgtccttccatctaattgggaaaaggttactctattgaaccatctgctgattcccttaccttttcactcttttgtcagtattcctttaccagtaaattcttggttatctaggtcctgaagtttcattcatgttttttttaaaagctttaatttttcttaggaaaactgtttctctcatcttaaagcagactatgatcttttctactttgttatacaatctgaacataatgaacactctaaagtcaggcatggattttatcataaaagcagatcgtattaagatttttttaaaaaagaaccaggattgaggaatctgtagctaataatttaataattcaccagcatgttttgggctcccacttcatgctggccactgggctaggcactgagggtgcagaagcaaacaaatcagcctcctggccctcagatttgcattccagtgagtccattcataaaacctaactcaaagccagcaacacccccaaaagggctg

SEQ ID NO: 102120 - DNA, 751 bp, Homo sapiens
ggttctatataggctttgcttccacaaggcctgggggatgcaacacctgttgatgcttctcagttttccactgcctttgacaggttggtggtttttaagccctttccactgtaccatccctactgcccctggtgcgaaagcatcatcttttgctcttgatctctaggtgggtaaaacctgcctgattagtagtgattcagatagtgtgacctccttcagttttctaagggctgaaactccttttttttttttccttttttcatgacttcagaggtaatcaggctctaggggactgattctctctaaccaaactctggagactgaattgtaaatccacatgcaaggttattaatttacagtgggaggtatacctatccagagatctgcatagagccccttcctgctctgctctagagaccaaattactataagaagggtccttgatgtgcaaagaattggacaagggaaattgggtgttgccaaaaggctgtttaaagcaagcagccttgattttggtgatccttcacttttctagtattttctggcttccgttgctttgttccttctttaaacttttcttttaatgctgtcatccattgaaatcctatacagagaaaagaaagcctgctcatccttcaggcccatgcatcctaggagctacaaaccctataaagcctttctgattccccagcatgttgtttttattctttgttcctttagcactttgtggataccactttttggaatattt

SEQ ID NO: 102121 - DNA, 367 bp, Homo sapiens
accactgtatcccaagcacctactcagcataatggttgatgttttatacattattaatgtttcagaatattatagtgtaaaagtgatcattctgtaccataattttcatcatatattcataagaagactgagagattatgccaaagttgtgatgactccaaaatactaataggaaattgctctatttttattagaggcaaatctagggtattgaacactaccagaacaatgttggtattcccagcatgactttttgttgttggagaccatgggtaggtttgtctgaagactggaagagactcagacttattttgctattaaatgttgtgcaatttatttaatatctaatacctattgaaaaaccagt

SEQ ID NO: 102122 - DNA, 431 bp, Homo sapiens
  misc_feature (416)..(416): n is a, c, g, or t
aacactgtccggagcactagggaaaacattttaagaaaaatactaataaatctaatcctctccaaaagggctaaattagtgcactcttctagcaggatctgaagcccaagaaataaagtgccagccgcaattctctttcacaacagcagggtaagaacgagagtctttgttcaatctttctccacttctgactcagtcacttactcagcagggtttatccatttcactacttcaactttcttcccaaacttcttctggcctcctccagcagtttctctttcccaacatccaaattctgttcattttccataacccattagcaaaaatagaagcatgaggccttagccaaacaaatccaagaaagtcttgtgtgtgtgtgtgtgtgtgtgtgtgtgtgtgtgtaattgtgtgtgttnggggaacaggtggga

SEQ ID NO: 102123 - DNA, 442 bp, Homo sapiens
ctctctcctaatttctctatgaaaaatccttgatttaatctaagatgggaagagagaggaagaatgactaacactttgtatttccatataggctcaggaatagggtaggaactagggtgaggtggaattttaaataaggacagtctctgacaaggcaggtttagggagaagtgagtgaagcagggtcgtgcaagtgtagcgtcggagcctacctttatttaaaagtttcatatcttgttcatcatggatattatttacctaatcagtgagtgtttttggtgccctcttaaattttccacccaaggtaagtagccttgctgactttaccttactccaggcttgttcaggacctttcaaataatttgctcagagacacccaactagaaagcggcaggatcactttggaaagttaaggcaggccacatagccaggggctgtctct

SEQ ID NO: 102124 - DNA, 441 bp, Homo sapiens
accttctatttttcggaggcaggcatgaggccccggagcctctccctccctcccctgctctccctacagggaagctactcccagcttgaggctttagctcagtgagcactcgggccctgtctcctgctaaccctcctggagtgtcctctgcctgcatgggcggatcaaggtgctattagcgctattccaggccagggggaggagtagcccttgttcttggcctaattctaatcagccctgcagccaccagaaaagggaaaaattcctttgcctgagattcccctggtccccagggtaccttctgtccatgaccaggctggcatgagcagagcgagagtctcttctcctttcctcacaagccagcttcttcatccatgtttgggtttcatttagagaaatccttcccccttagaggcagaggccaaatgcctcgtggctgag

SEQ ID NO: 102125 - DNA, 308 bp, Homo sapiens
cccttttgccatcctgagcttagggccgccctagaaacttggtcaagtgggaggagcagccttgaaaggtggtgtaatcagctttcttcctcctctctccaccctcttgaagctccacccctgagcagatgcttttgcactgcctgtgctcgttgctgctagggagaagacattttccttattttcattatataaaatatcttaaagggataggagcttataggaattaagtatcaaggctgtccatctctgtgtagttctagtttttatagaaccagtttttattttcactttccttcactcatcac

SEQ ID NO: 102126 - DNA, 336 bp, Homo sapiens
tgggcaggtcgccgcggggccaggcagcagatccggcaaagagagcagggaacaggaaggggcagtggttacgactttggagcgagagtgccaaggttcaaatcctgcctcttaccttggtgcaatttcccataatctatccctgtaatacactttttcatacattgagttttcttttcagtttgtttttgtttttttttgttgttgttatatatttctttttttagtttttcctccactatcctaaatcatcagcatttgttttttttaagacagagtctcactcggttgcccaggctggaatgcaatgacatgatctcagctcactacaacctc

SEQ ID NO: 102127 - DNA, 268 bp, Homo sapiens
ttatagatggttaaatcattttttgactactatcattttttaggtgtgacttgtggaagctttaatttcgtgggtccactaacaaatacttgtagtaacgtttgtttaagtagaattgaaaagttcttcatttactttataatgactattagggtgagcatttcagtttttcatttttgactcggaatttgtcaggaattggtttgctatagagatagtgtttagatttggaaagcaagtttagtaatcaaagtaatttaatagagat

SEQ ID NO: 102128 - DNA, 282 bp, Homo sapiens
gactaaagcctccaagctcaaaacagattgaagactgaaacggcctttattggccaggtgtagtggctcccgcctgtaatctcagcactttgggaagctgaggcagttggattacctgaggtcaggagttcaagaccagtctggtgaacatggtgaaaccccgtctctcctaaaaaaacaaaaaacaaaaattagccaggtgtgggggcaggcgcctgtaattccagccaaaaaaaaaaaaacttttttttttttttttgacagagtcttgctctgtcgccc

SEQ ID NO: 102129 - DNA, 363 bp, Homo sapiens
ttttttcctttctttaattgaagtgccctattacctgtttctggagtaggtattttcaaactggtccccctactttttccagttttgctccttagacacttctttccaaattagaactcttggaaacacacataacaacaacaaaacacctacctgctgattgtgctactttcctactcaaacatcttgtcttactgcagagagatggctagtccacgcaagtccaaattacagactgatcaaatctaggagtgactgcactgcctactcggaaatcaaagattctgggaagtgtcacctgcctgcttttggaaccagtattcttctgcagtggtctgcatttttgccatagtagttcatctg

SEQ ID NO: 102130 - DNA, 501 bp, Homo sapiens
cagtgtttgggcttattcccatataaaaaggagaaaggagggttgggggtggggaagggttgattttgtttcttctagagcttttttcttcttttgtttttgtttgttttgttttgtttgcatgcaaaaggtatttagttatgtcagtaactgagacttacttaaccattttacaactctttccccaaataaagtacttaaaactctccctgcattagtaggtagccagtttgtattgtgtttataggtttttataaagtcagctactaacctggtactatgtagattgtctaactgtatagatagatagcattaacatttgtgagaaatttcaacaaagaggttaaaccaatacgtttggaattgctggataaaagacccagagcagttaatcttacaattggtgttttccccaaagtatagacatgactgcccgtaaatactgctggggagtctaggactaattccagaaataaaaatacttctggtctacaaatgtga

SEQ ID NO: 102131 - DNA, 202 bp, Homo sapiens
aaacctaaaataaaagttataaaaaagaaaaaccaacaatgttctcctttcccatgactctcattcccactatcattccttcctcaaaacaagaaatggcagtttaatgtttatattttttctatgttcatatgaatgcactcaaaaatattcacaccataaaatgctttttcttatttaaaaaaataaaaaatgaaaatga

SEQ ID NO: 102132 - DNA, 162 bp, Homo sapiens
tgacttcccgagagttcctgacatgatggccaggaagagtttggacagacagctcagagtaggaagagagttcagagcggggagggagacctgttgactctgggaaggggaaagggaaaaaacactggcatcctgactgcagggaaacaatgaggcagcgga

SEQ ID NO: 102133 - DNA, 335 bp, Homo sapiens
tgtagagatggggtttcaccaagttgcccaggctggtgtcaagctcctgagctcgagggatcttcctgcctcagcctcccaaagtactggtattacagacatgagccactgcacccagctcctgattaccattattctcattttacacaatcctggggctgaaagagtaaaccatttgcccaaatcataatttgcggatgcgaggtgtcaggactgaaggatccacatttctgtgctcctcacctcatgaccaggaagcatgcagaaccattctgttcctacagatcacagcacaaaggctcacatacacactctgatgctcacctagcatggcc

SEQ ID NO: 102134 - DNA, 309 bp, Homo sapiens
catgagggaggtacacgtaagcaaaacaaggtctggttggaaaaatattccgaggctttctgtctcagcagcttaggggtaaacctatgcccagaatcagtaggaaagttacaagggtcttttccttccagaagctaaggattccatcaaaggagcaagctcagacactggtaacaatgcgccccctactgacaaaattaacgtctacagtacagcaacgcttcatatacccaacatagatctccttagaatagcattgagagagagaaaatacctaggacctacttgagaaatttaaatccttcgaaa

SEQ ID NO: 102135 - DNA, 569 bp, Homo sapiens
gtgaaacatgaaatttctaatgaagaagaagaaacttctattacagtgtatctgatgtacctcattattaaaagaagacctttagttttattatatcaaatggtttcctgaaacccttttagcgtaagattcctgtggttaaacattaaataatatgcaatggaagatgtcattttaaattaagaattcttaactttcaatcagattttcttaatttgagcagaatctgctcattttaattcagcatcctattttaaactacttgttcctgtagtgtggttctattctttcttgctgtttataatttagtactgtatgtaggcacttaagaatgggcatcttgttagtattgtcttcataatactaaatacagaatacctctctccaagtggatgtgtagatattttactcagttctttaacacacttataaaatatacagatgacacaaagctgtgtcttttgtgattagattaggtatttcagtaatttagtttttaatttcctatgcaatttaagtatcctattatccttattggcgggggtggtgatgcttactgttgtacatgt

SEQ ID NO: 102136 - DNA, 2622 bp, Homo sapiens
ccatgggatcgctgcttgcgctcctggcactgctgccgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggaccgcatcaaccgtgacccgcacctgctgcctggcgtgcgcctgggtgcacacatcctcgacagttgctccaaggacacacatgcgctggagcaggcactggactttgtgcgtgcctcactcagccgtggtgctgatggctcacgccacatctgccccgacggctcttatgcgacccatggtgatgctcccactgccatcactggtgttattggcggttcctacagtgatgtctccatccaggtggccaacctcttgaggctatttcagatcccacagattagctacgcctctaccagtgccaagctgagtgacaagtcccgctatgactactttgcccgcacagtgcctcctgacttcttccaagccaaggccatggctgagattctccgcttcttcaactggacctatgtgtccactgaggcctctgagggcgactatggcgagacaggcattgaggcctttgagctagaggctcgtgcccgcaacatctgtgtggccacctcggagaaagtgggccgtgccatgagccgcgcggcctttgagggtgtggtgcgagccctgctgcagaagcccagtgcccgcgtggctgtcctgttcacccgttctgaggatgcccgggagctgcttgctgccagccagcgcctcaatgccagcttcacctgggtggccagtgatggttggggggccctggagagtgtggtggcaggcagtgagggggctgctgagggtgctatcaccatcgagctggcctcctaccccatcagtgactttgcctcctacttccagagcctggacccttggaacaacagccggaacccctggttccgtgaattctgggagcagaggttccgctgcagcttccggcagcgagactgcgcagcccactctctccgggctgtgccctttgaacaggagtccaagatcatgtttgtggtcaatgcagtgtacgccatggcccatgcgctccacaacatgcaccgtgccctctgccccaacaccacccggctctgtgacgcgatgcggccagttaacgggcgccgcctctacaaggactttgtgctcaacgtcaagtttgctagccccctttcgcccagctgacacccacaatgaggtccgctttgaccgctttggtgatggtattggccgctacaacatcttcacctatctgcgtgcaggcagtgggcgctatcgctaccagaaggtgggctactgggcagaaggcttgactctggacaccagcctcatcccatgggcctcaccctcagccggccccctgcccgcctctcgctgcagtgagccctgcctccagaatgaggtgaagagtgtgcagccgggcgaagtctgctgctggctctgcattccgtgccagccctatgagtaccgattggacgaattcacttgcgctgattgtggcctgggctactggcccaatgccagcctgactggctgcttcgaactgccccaggagtacatccgctggggcgatgcctgggctgtgggacctgtcaccatcgcctgcctcggtgccctggccaccctctttgtgctgggtgtctttgtgcggcacaatgccacaccagtggtcaaggcctcaggtcgggagctctgctacatcctgctgggtggtgtcttcctctgctactgcatgaccttcatcttcattgccaagccatccacggcagtgtgtaccttacggcgtcttggtttgggcactgccttctctgtctgctactcagccctgctcaccaagaccaaccgcattgcacgcatcttcggtggggcccgggagggtgcccagcggccacgcttcatcagtcctgcctcacaggtggccatctgcctggcacttatctcgggccagctgctcatcgtggtcgcctggctggtggtggaggcaccgggcacaggcaaggagacagcccccgaacggcgggaggtggtgacactgcgctgcaaccaccgcgatgcaagtatgttgggctcgctggcctacaatgtgctcctcatcgcgctctgcacgctttatgccttcaatactcgcaagtgccccgaaaacttcaacgaggccaagttcattggcttcaccatgtacaccacctgcatcatctggctggcattgttgcccatcttctatgtcacctccagtgactaccgggtacagaccaccaccatgtgcgtgtcagtcagcctcagcggctccgtggtgcttggctgcctctttgcgcccaagctgcacatcatcctcttccagccgcagaagaacgtggttagccaccgggcacccaccagccgctttggcagtgctgctgccagggccagctccagccttggccaagggtctggctcccagtttgtccccactgtttgcaatggccgtgaggtggtggactcgacaacgtcatcgctttga

SEQ ID NO: 102137 - DNA, 1485 bp, Homo sapiens
actggggttcaggcaggatttagtatgggttaaggatggaagggctaatggtggtcttagctctggcattgggttccatgttagggtgaatgttgaggtcacatcagggtaacacactagtccaaccttctcttccttccgtcaagtttgctagccccctttcgcccagctgacacccacaatgaggtccgctttgaccgctttggtgatggtattggccgctacaacatcttcacctatctgcgtgcaggcagtgggcgctatcgctaccagaaggtgggctactgggcagaaggcttgactctggacaccagcctcatcccatgggcctcaccctcagccggccccctgcccgcctctcgctgcagtgagccctgcctccagaatgaggtgaagagtgtgcagccgggcgaagtctgctgctggctctgcattccgtgccagccctatgagtaccgattggacgaattcacttgcgctgattgtggcctgggctactggcccaatgccagcctgactggctgcttcgaactgccccaggagtacatccgctggggcgatgcctgggctgtgggacctgtcaccatcgcctgcctcggtgccctggccaccctctttgtgctgggtgtctttgtgcggcacaatgccacaccagtggtcaaggcctcaggtcgggagctctgctacatcctgctgggtggtgtcttcctctgctactgcatgaccttcatcttcattgccaagccatccacggcagtgtgtaccttacggcgtcttggtttgggcactgccttctctgtctgctactcagccctgctcaccaagaccaaccgcattgcacgcatcttcggtggggcccgggagggtgcccagcggccacgcttcatcagtcctgcctcacaggtggccatctgcctggcacttatctcgggccagctgctcatcgtggtcgcctggctggtggtggaggcaccgggcacaggcaaggagacagcccccgaacggcgggaggtggtgacactgcgctgcaaccaccgcgatgcaagtatgttgggctcgctggcctacaatgtgctcctcatcgcgctctgcacgctttatgccttcaatactcgcaagtgccccgaaaacttcaacgaggccaagttcattggcttcaccatgtacaccacctgcatcatctggctggcattgttgcccatcttctatgtcacctccagtgactaccgggtacagaccaccaccatgtgcgtgtcagtcagcctcagcggctccgtggtgcttggctgcctctttgcgcccaagctgcacatcatcctcttccagccgcagaagaacgtggttagccaccgggcacccaccagccgctttggcagtgctgctgccagggccagctccagccttggccaagggtctggctcccagtttgtccccactgtttgcaatggccgtgaggtggtggactcgacaacgtcatcgctttga

SEQ ID NO: 102138 - DNA, 799 bp, Homo sapiens
cgagcgagcgagcgggagccggagcctcgcgccccccgctccactccgattctctccgcgccagagcgtcaagtttgctagccccctttcgcccagctgacacccacaatgaggtccgctttgaccgctttggtgatggtattggccgctacaacatcttcacctatctgcgtgcaggcagtgggcgctatcgctaccagaaggtgggctactgggcagaaggcttgactctggacaccagcctcatcccatgggcctcaccctcagccggccccctgcccgcctctcgctgcagtgagccctgcctccagaatgaggtgaagagtgtgcagccgggcgaagtctgctgctggctctgcattccgtgccagccctatgagtaccgattggacgaattcacttgcgctgattgtggcctgggctactggcccaatgccagcctgactggctgcttcgaactgccccaggagtacatccgctggggcgatgcctgggctgtgggacctgtcaccatcgcctgcctcggtgccctggccaccctctttgtgctgggtgtctttgtgcggcacaatgccacaccagtggtcaaggcctcaggtcgggagctctgctacatcctgctgggtggtgtcttcctctgctactgcatgaccttcatcttcattgccaagccatccacggcagtgtgtaccttacggcgtcttggtttgggcactgccttctctgtctgctactcagccctgctcaccaagaccaaccgcattgcacgcatcttcggtggggcccgggagggtgccca

SEQ ID NO: 102139 - DNA, 2732 bp, Homo sapiens
  misc_feature (362)..(362): n is a, c, g, or t
  misc_feature (784)..(784): n is a, c, g, or t
  misc_feature (1289)..(1289): n is a, c, g, or t
  misc_feature (1665)..(1665): n is a, c, g, or t
  misc_feature (2056)..(2056): n is a, c, g, or t
  misc_feature (2117)..(2117): n is a, c, g, or t
  misc_feature (2212)..(2212): n is a, c, g, or t
ttactgtgtgtttctctacctacctctcattctcaccttcttttcctagctttttttttctctttatttttcccctaggattctcctcatttcaagcccttcttccttctcctgctcttccctctattccttctcttccacttgttctgctcctttctcacttctttcacctcttattcttctttctgcccaatatttgtctccaattttcatatagttctgcctctttcttccccccgtctctgctgccccctagcttcccctgttaaatcccctcttccctgctatatccacctgtcccctctctggcatccccagatcccagttctccccaggctgtggttctccctgtgctctccttntcactggctgcccctcttgctctcccagcaccatgctgctctgtctgccctggctccaaatccctccttctctccccaactctccatctgaggagcctccccttttctgcccctctccctatcttgctgaactttatctctctagaaacccagtttttctctaaatttctctagttgcttttctccccctgctcctttctcagcatcttcatgcactgtctctgcaaatccctcatccaccatctactttgccatctgttttgttttgttttttgttttttgagatggagttttgctcgtcgcccaggctggagtgcaatggtgcgatcttggctcaccgcaacctccgcctcccgggtaaaagcgattctcctgcctcagtctccagagtagctgggattacaggcattcgccaccatgcntggctaattttgtattttttagagacagggtttctccatgttggtcaggctggtctcaaaactcctgacctcaggtgatctgcccgcctcagcctcccaaagtgctggaattacaggcgtgagccatcgcacccagctgccgtctgtttatgggtctccttcattcttctttcccatttcaccatttttctatttcctctcctccacacattcatagggaggggactgcagtcagatccccacctcaagagcccatttcctgtgggatggaatttgggacaagagaaaccttaacgtcctgagatagaagtcacgtccccacactcgatatcaggagaaggggaggcctggggagcagaagggcccccgatcaaggaggaaaaaggcaggagaaagtcaggagaggggcagggtctgcaggatcccaggaccaggaagagttcacggcctccctgggactggggctgcgtcgctgcgctccaggagctgacgagggagcggagcngatgggaagctcccagggcgggaatcaaccttgcggtgaggactttaaaaaaggtgcgggccagtgcaggggacactgaaggatttgaggcaggaaaactccgcgataagagctgtctatatggccctgtggcagaagcacgggggacacgaccccatggaactgtgtccattaaacctctttgtcttcataaattacccagtctcgggtatttctttattagcagcgtgagaacagactaatacagtaaattggtaatggtatagagtggggtgctgctataaggatacctcaaaatgtggaagcaaattttgaactgggtaacaggcaaaggctggaacagtttggagggctcaaaagaagacaggaagacgtnggaaagtttggagcttcctagaaaatggttgttgaatggttctgaccaaaaagtccaggctgaaggtggtctcagatggagatgaggaactttattggaactggagcagaggtgagctgcaggggcggagccctcatggagaacctctgctagagcagtgcagaagtaaaatgtggggttggagcccccacacagactactcactactcgcctagtgcagccgtgagaaaagggccaccctcctatagaccccagaatggtagattcaccgacagcttgcaccatgtgcctggaaaagtagcagacacaacaccagcctgtgaaagcagccaggagaggagctgtaccctgcaaagtcacaggggcagacatgggttccctgcaagaccantggaaccaacctcttgcataagtgtgacctggatgtgagacacggagtcaaaagagatcantttggagctttgactgccctgctggatttcagactggcatggggcctgtgacctgttttggccaatttctcccatttgcaacgggcgttatttanccaatacctgtgcctccattgtacctaggaaataactaacttgctttttattttacaggctcataaacagaagagacttgcttgtctcagatgaaactttggactgtggacttttgagttaatgctgaaataagactttgggggactgttggggaggcatgattggttttgaaatgtgaggacatgagatttgggagggaccaggggcaaaatgatatggtttggctgtgtccccaccaaatctcatcttgaattgcagctcccatgatccccacatgtgggagggacccggggggaggtaactgaatcatgggggtgggattttcccatgctgttctcatgatagtgaataaatctcatgagatcttatggttttataaagggcagtttccctgcacgggctctctcttgcccgccaccacgtaagacatgtgtttgctcctccttcaccttctgccatgattgtgaggtctctctagccgtgtgaaactgtgagtccattaaacttctttttctttat

SEQ ID NO: 102140 - DNA, 286 bp, Homo sapiens
tgaaggctaagataatgagactacttctcttgtgggactttccaaaactcctatgtcatagtcatcaacttatatataagtaaaaatgcttatttgtgttttagcatttgctctttgcatcaaacctccactgactttgggaataataagatctgctaccccaagaaagtctgccaattccattagtaacacattcaactggatcaaaaaactgaagagttagtgaatattttatatcgtgggtttttaaaagatatttttgtgtgaataaaaaaggactttctca

SEQ ID NO: 102141 - DNA, 679 bp, Homo sapiens
ccttcatcctcacatggtgccttccctcatgcatgtctgtgtctacatttcccctttttcatcaggacaccagtcacactggattagggccaccccctaatgacctcctctagctcgattagctctgtaaagatgctgtttccaaatcaagttacatactgaggtactaagggttaagactccagggtttctttcacggaggccaaaattcaatccataataaccactcagttgccataagacactgggcaagtaggttagccttcatcggtaaaatgggcctaataattgcgcctactgcatttgggtgatggagacagggtccctggcagcaaagaagcacagccctttccccttacgtaagctatacagatactgacatgaagaaggctggaggctctgctcatgagcatgggccttggaaccaggctggtcggggtctgagccctctctctgccactggctggcagtggccttgcacaagtggttgaacctgagacggatctcaagatacattttaagtattatacaataatgcacgtcaactccttagcacgcagtgagctctccatgaatgtcagcggcctcaggcaaagcagaggtagggactgacagcatcacctttgtcccaaccgtatcttgcaaattcttcaaggtggctgcttaaactcaacagtta

SEQ ID NO: 102142 - DNA, 369 bp, Homo sapiens
tgaacattcgtgtcctctgcccgggtctgtgccagctctgactcaaggtgcagcaggatcccgttgagctgctccatctgtagggcgtagcgggcctccacctccctcaggctgttctccaagctggccttcagatttctcatggagtccaggtcgatctccaaggactggactgtacgtctcagctctgcgacctggggcaccaccactccacacttggtgatcctcctacgatttcctgcgaggcacgacacaccctgcccacgctcactacatgaggctgaacatcctccaaggaccccagaatgtcttccttcttgcctcagcttgtctttctaacacaggcccttacttccccggcatcatggc

SEQ ID NO: 102143 - DNA, 366 bp, Homo sapiens
  misc_feature (361)..(361): n is a, c, g, or t
  misc_feature (363)..(363): n is a, c, g, or t
  misc_feature (365)..(366): n is a, c, g, or t
tagttggttcttgcttttttatccaatttgacagtctctgccttttaattgatgtttggatccatttacatttaatgttattatcagtatggctaggtttgagtctatcatcttgctatttgttttgtatttgttccatgtatgctttgttcccttttctccctttttctgccttcttttggattactgtttttttttaatgattccattgttttttcttccttgatttattagctgtacctcattgttttattatcttagtagttgctttagagtttatagtataaatgtttaacttcctcctcctggctttcatgctagtgtcataaattttacttgtagattttataaaccttaaaananann

SEQ ID NO: 102144 - DNA, 401 bp, Homo sapiens
aaacaaaccaaaatagacacatacacacacacacacgcacagagtaggtcaaaacaaaacagtgtgggcatcctttctaatttttcaaacctcacctgctgaatagcatatttaataaagcacataccacttatttgatctggcagtacttaacgcaataacttacacacaaagaaagacccaaacatttagccacaggatgtcatcaaataagggaagaaggtttgtaataatggtttgtaattaatgtttaggttttaagagatgccttaagaaaaacaaaaggtcttattaactcatttgccctcctaaataactctatttttcaattgactgagcaaacacccaattagagtggtaatttattagggtcatacattagctgaaaagaaaacagaaaa

SEQ ID NO: 102145 - DNA, 103 bp, Homo sapiens
ggtccgagtgacctgggtgccttcctgcccaccggggctggaaccaggagcagctttgttctactggtgccaatgaaggattgggagcccccttcggggagtg

SEQ ID NO: 102146 - DNA, 368 bp, Homo sapiens
ggaggcggaggttgtggtgagccgagatcgcgtcactgcactccagcctgggcacggagccagactccgtctcaaaaaaaaaaaaaaaaaaaaagcaatatgtgtatataactctctgctttgttcacttgacactctagtatgatgacctttgcatatcattgtaaagttttagtagaggagtgatatggtcagtttagcatctcataaacactattacagctgtagcatgcagaacagagggagaggggaacaaggcaagacatgagcagtgtttgacataacataggagcaatataactgagagaaaatgaagattttaaaattagccattttaatcaaataacaaccatccattactgatgtag

SEQ ID NO: 102147 - DNA, 449 bp, Homo sapiens
ttgagcccctaagtgctatattctgaaatacaactgtgaaagaatctctgttctgcaggaacttgcaaacacaaaatgttctgcctaacatcagcatcccaggagatgtcaaaaatgcttccatcctagagtcaaacaagttagtgaaatgtagcataatctccctattggaactcaaaactgaatttggcatattaaagcctgtaagaagtcctgcaacaaagaaacccaactttccacatacttgattaataagcaaaactttcttcaccttctctacctagcttgacccccacaaaaataccttcaactgcactctaattagctttctagattaccttgtctacccctttcttcttttacctaatccaaactgtccattccccacttgagattaatttcaccatctgctttttctgcagtgcagttgccaagcatacataatgctg

SEQ ID NO: 102148 - DNA, 209 bp, Homo sapiens
tatattactcatttctatattcaaagttataaagagagagaaggagagaggacttaagggagttagcaatcccccttgaggaggctgtagaatttccagcgagctgcaaatttgggtgccagagtatctgctggggtgtgggaagaaaatgttagatttctacttatactcatttctcaacaaaaataaaagagaaattgtgatttatt

SEQ ID NO: 102149 - DNA, 442 bp, Homo sapiens
tctttcctttcttacagggttttggaaatttgcccatctgcatggcaaagaccgatctttctctgtctcaccaacctgacaaaaaaggtgtgccaagtgacttcatcttacctatcagtgatgtccgggccagcataggtgctgggttcatttaccctttggtcggaacgggaagcagagaatctcccctctggctctagttggagaatcccaacccaagcaagtccatctttgaacaataaacatctccagtactgctggctttggaagaccccatggtgagatgctggagcttttttccgctcctgatttcactttctaaatatttacttttactttccatgttcacttgtaggccagatttttttttcctaccattgaattatttcatcatgttctatttaattattgtcttaattggcattggtgacgacaaataata

SEQ ID NO: 102150 - DNA, 263 bp, Homo sapiens
tctttcctttcttacagggttttggaaatttgcccatctgcatggcaaagaccgatctttctctgtctcaccaacctgacaaaaaaggtgtgccaagtgacttcatcttacctatcagtgatgtccgggccagcataggtgctgggttcatttaccctttggtcggaacggtgcaccactgacatcatggctcggctggactctggaaagcaggaaattgctggagcatgtttgggcatcaatgatgtcacccgctacgaatg

SEQ ID NO: 102151 - DNA, 395 bp, Homo sapiens
ggtaagtgaagggatggtgaagccatttagggaaatacagaagatggatggataagtagatttcagaaatggagtcaggtaatttcagatttgaatttttgaggtattcataggactctgcttgagatgttgtatgagtctcctgaaactgcggattgggttttggaaggctctgtgaaattccagttgcagatttggaagcaaatatgttcagctttaaaaaagcatctgagacttatgccttaaaaaagaacaaacttgccagtaatgaaataccataccagtaatcaattctgagaaaagtcttattttgccagtactctaatgagaaaagtcaagacatttgaaacagattcaagctaaagtatcataaacatctcgacacaaattactaa

SEQ ID NO: 102152 - DNA, 96 bp, Homo sapiens
gtaacatctacttctctggactctggcaaccagtgatctgtgttctgcccctgtggttttgcctttttgaggatgtcatacagatggaatcagaca

SEQ ID NO: 102153 - DNA, 105 bp, Homo sapiens
cacaaaaaaaaaagaaaagaatagacaaatagatcaatgaaacatcatagagagcctgggagtagatccacccagtaaatccacccagatagtcaacccattcac

SEQ ID NO: 102154 - DNA, 440 bp, Homo sapiens
cacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctg

SEQ ID NO: 102155 - DNA, 830 bp, Homo sapiens
ctcgtcaacggctagtcaacggctgcggggacaagtccgttgaggctgccaggcgagtcaggcctttctggacctcgcctgactcggatgggctgtgcctgaaattgacccagctccactagggattatgaagaaacaaggagtaaacccaaagccgctgcaatcttcccgccccagcccgtctaagcggccgtacggggcctcccccgcccgggagctggaggtggaaaagtcggccctaggcggcgggaaactgccagggggcgccaggaggtcctccccggggaggatcccaaatctgaaaaagcgaaaaggcttggagctaaaggtggtggccaagacccttctcgaccccttccagttcgtccgtaattccctggcgcagctccgggaagaggtgcacgaactgcaggcgcggtggttccccagcagaaccactctcagcatcgccatctttgtggcaattctacattggttacatttagtaacactttttgaaaatgatcgtcatttctctcacctctcatctttggaatgggagatgacttttcgcactaaaatgggactttattattcctacttcaagaccatcattgaagcaccttcatttttggaaggactgtggatgattatgaatgacaggcttactgaatatcctcttgtaattaatacagtaaaacgcttccatctttatccagaggtaatcatagctgcctggtatcgcacattcataggaataatgaatttatttggactagaaactaagacctgctggaatgtcaccagaatagaacctcttaatgagttcaaagctgtgaaggcatgtttcc

SEQ ID NO: 102156 - DNA, 347 bp, Homo sapiens
acatttctgttttacagatgaaagaactgagctttggaggctaaattacttgtcccaagttaatacagcttagaaagtgatagagtaagagcttgaacttggttttatttctagtgttctttgcagtaccagtagaaatagcaaatatattagttattgaagtcaggatactaaaatatctttacagattgagactgtaaattgaatccaaccaggtgaatttagcaatgataatatgtttcctgcacttgggttcccattcaatcacaaaatataaacaatcagcattgtttaaaggcggaaaaaaaacccaataggtagtttagctgtaaagtcagcatgaattg

SEQ ID NO: 102157 - DNA, 518 bp, Homo sapiens
gttcctctcaaaatataaatcttcgagagcctaatatatgaactagatgaagcagcttcattatcctcagataaagaattgtggtcagtggcttttatcagattcttcaaaagcgtctataaccccagaatgattaaggaccattactctgaaggaaacaaacatcatagacttctgtaatgacagcgtagtagatccaggatttgaaaataaaatgagagaaaagtatagaatttgttttcctgtggcttatgcccagaaggattcagaaaggaatgactgatttctttcaaagaatacaagcaaggtggatctccgtgatttctttgatttaagcaataagatgataagtctagattttagagtttttattttgtttttaaaaaactgtgatataatatacataacaaaatttacattttagtcatctttaagtgtacaattcattggcattactatattcatattactatgcaaccattactaccatctatctccagaactgttttctcttccca

SEQ ID NO: 102158 - DNA, 683 bp, Homo sapiens
accagagcccccgacaggacccttctgatggcaagtgggtgtgtctcctcccagttactcacccctccctccaaataaccacatgcccttcaccaagggccaggagaccttgttgcaaagaggcttggaaatgatgccatttgtgaagtgatattttttagtacctttcccaagttaatttgctgttttcttccgtccgatcattcatccacccatctgctggtttatttagcaaacgttgattccgtactctgtgagaggtgtgatgcttaggctagaacaacaaagagcccttcaggaggtgatgctgatgaaggtgtggcgatagggggtggctgttaacatgatcaatgctggtgcagaagaaaaatgctcaggactggaggaatcccttagaatgtgggggctgctcagagacatctacttcctacgtgctgatttctttaaatcttgctctaaattaatcacttctaaaatggagtgtctaacaccctgggaatcatctgtatgtcagggcctgtgctggggaaacatagtgagtagagccttgatctgcccatagatagctcccagagcagtgcaatgattattaaccttttttgggttatggcttttttgtgatactctgaagaaaattatgaatactttcctgaaaaaaatgcatatatgtatacaattttgca

SEQ ID NO: 102159 - DNA, 377 bp, Homo sapiens
ggcagagggcatgagctgagggggcatgggcagagggacgggcagagggggtgagcagctgattacagagctgctcagtaatccaggaatagccaagggcctggtgtcagtagggctcacaatgaggcccactgtctttaaacttcccagggttcccagcactgaggctcatttaatgggaactctgggtacatgagggtggtctccagcgacaccaagctggacttaggacctggagatcacaagcagaggacccgaggcaggcagcaggaagggcagcagcatcctgagccaccggcctcccccaccatcacccacccacaccgggatgtgggtgatgcaggaccagtgcgaagatggtgtggggacggtgggca

SEQ ID NO: 102160 - DNA, 407 bp, Homo sapiens
cacctttaccatacgctgctttgttttcttcacaacactcactactttcctcaattatgtcatttatttgcttactgtctatccctcatacaaatataatctttagacagtatattagttatctattgctgcataacaaattacatcaaaacttggcagcttcaaacaacaactatgtatgatgggtaagtcaggaatacaagagtagttgggctggtggtctggctcagcgtctctcaggagactatggtcaagctatggggcatggctgcagtcatctgaaggttaacgggctggaggatgctctgttcacccacatggctgttggcaagatgcctcagttcctgccaggtgaaccttttcacagggctgtctgaacacatggcagctgacttctcccagagaca
